United States Patent
Pizza

(10) Patent No.: US 8,980,277 B2
(45) Date of Patent: Mar. 17, 2015

(54) HYBRID AND TANDEM EXPRESSION OF NEISSERIAL PROTEINS

(75) Inventor: Mariagrazia Pizza, Siena (IT)

(73) Assignee: Novartis AG, Basel (CH)

( * ) Notice: Subject to any disclaimer, the term of this patent is extended or adjusted under 35 U.S.C. 154(b) by 1601 days.

(21) Appl. No.: 10/488,786

(22) PCT Filed: Sep. 6, 2002

(86) PCT No.: PCT/IB02/03904
§ 371 (c)(1), (2), (4) Date: Feb. 25, 2005

(87) PCT Pub. No.: WO03/020756
PCT Pub. Date: Mar. 13, 2003

(65) Prior Publication Data
US 2005/0222385 A1  Oct. 6, 2005

(30) Foreign Application Priority Data
Sep. 6, 2001 (GB) .................................. 0121591.2

(51) Int. Cl.
*A61K 39/385* (2006.01)
*A61K 39/095* (2006.01)
*C07K 14/22* (2006.01)
*A61K 39/39* (2006.01)
*A61K 39/00* (2006.01)

(52) U.S. Cl.
CPC ............ *A61K 39/095* (2013.01); *C07K 14/22* (2013.01); *A61K 39/39* (2013.01); *A61K 39/00* (2013.01); *A61K 2039/53* (2013.01)
USPC ................... 424/197.11; 424/194.1; 530/350

(58) Field of Classification Search
None
See application file for complete search history.

(56) References Cited

U.S. PATENT DOCUMENTS

| | | | |
|---|---|---|---|
| 6,165,747 A | 12/2000 | Ingham et al. | |
| 6,248,329 B1 * | 6/2001 | Chandrashekar et al. | 424/191.1 |
| 7,348,006 B2 | 3/2008 | Contorni et al. | |
| 7,576,176 B1 | 8/2009 | Fraser et al. | |
| 7,785,608 B2 | 8/2010 | Zlotnick et al. | |
| 7,862,827 B2 | 1/2011 | Giuliani et al. | |
| 8,101,194 B2 | 1/2012 | Zlotnick et al. | |
| 8,226,960 B2 | 7/2012 | Masignani et al. | |
| 8,273,360 B2 | 9/2012 | Pizza et al. | |
| 8,293,251 B2 | 10/2012 | Scarlato et al. | |
| 8,394,390 B2 | 3/2013 | Galeotti et al. | |
| 8,398,988 B2 | 3/2013 | Contorni et al. | |
| 8,398,999 B2 | 3/2013 | Masignani et al. | |
| 8,524,251 B2 | 9/2013 | Fraser et al. | |
| 8,563,007 B1 | 10/2013 | Zlotnick et al. | |
| 8,574,597 B2 | 11/2013 | Zlotnick | |
| 8,734,812 B1 | 5/2014 | Galeotti et al. | |
| 8,840,907 B2 | 9/2014 | Pizza | |

| | | |
|---|---|---|
| 2004/0092711 A1 | 5/2004 | Arico |
| 2004/0110670 A1 | 6/2004 | Arico et al. |
| 2004/0167068 A1 | 8/2004 | Zlotnick et al. |
| 2005/0222385 A1 | 10/2005 | Pizza |
| 2006/0051840 A1 | 3/2006 | Arico et al. |
| 2006/0171957 A1 | 8/2006 | Pizza |
| 2006/0240045 A1 | 10/2006 | Berthet et al. |
| 2006/0251670 A1 | 11/2006 | Comanducci et al. |
| 2007/0026021 A1 | 2/2007 | Fraser et al. |
| 2007/0082014 A1 | 4/2007 | Costantino |
| 2007/0253984 A1 | 11/2007 | Khandke et al. |
| 2008/0241180 A1 | 10/2008 | Contorni |
| 2009/0232820 A1 | 9/2009 | Fraser et al. |
| 2009/0285845 A1 | 11/2009 | Masignani |
| 2010/0267931 A1 | 10/2010 | Arico et al. |
| 2012/0107339 A1 | 5/2012 | Granoff et al. |
| 2014/0037668 A1 | 2/2014 | Giuliani et al. |

FOREIGN PATENT DOCUMENTS

| | | |
|---|---|---|
| EP | 0 196 056 A | 10/1986 |
| EP | 0467714 | 1/1992 |
| EP | 0 474 313 A | 3/1992 |
| EP | 0 978 565 A | 2/2000 |
| EP | 1645631 A2 | 4/2006 |
| EP | 1790660 A2 | 5/2007 |
| EP | 2351767 A2 | 8/2011 |
| WO | WO 88 00238 A | 1/1988 |
| WO | WO-9629412 | 9/1996 |
| WO | WO-9817805 | 4/1998 |
| WO | WO-9924578 | 5/1999 |
| WO | WO-9931132 | 6/1999 |
| WO | WO-9936544 | 7/1999 |
| WO | WO 99 57280 A | 11/1999 |
| WO | WO 00 23595 A | 4/2000 |
| WO | WO-0022430 | 4/2000 |

(Continued)

OTHER PUBLICATIONS

Sigma Catalog, 1996, pp. 1957-1963, 1996.*
Morely et al (Vaccine, 20:666-687, 2002.*
Boslego et al (In Vaccines and Immunotherapy, Cryz Jr., Ed. Pergamon Press, 1991, Chapter 17, pp. 211-223).*
Feng et al (Infection and Immunity, 64(1):363-365, 1996).*
Ellis, R.W. (Chapter 29 of "VACCINES" [Plotkin, S.A. et al. (eds) published by W. B. Saunders company (Philadelphia) in 1988.*
The Dictionary of Immunology, Herbert et al eds, Academic Press, 1995; one page.*

(Continued)

*Primary Examiner* — Patricia A Duffy
(74) *Attorney, Agent, or Firm* — Morrison & Foerster LLP

(57) ABSTRACT

Two or more Neisserial proteins are joined such that they are translated as a single polypeptide chain. Hybrid proteins are represented by the formula $NH_2$-A-[-X-L-]$_n$-B—COOH where X is an amino acid sequence, L is an optional linker amino acid sequence, A is an optional N-terminal amino acid sequence, B is an optional C-terminal amino acid sequence, and n is an integer greater than 1. Proteins where each of the n -X- moieties shares sequence identity to each other -X- moiety, the protein is a 'tandem protein'.

9 Claims, 7 Drawing Sheets

(56) References Cited

FOREIGN PATENT DOCUMENTS

| | | |
|---|---|---|
| WO | WO-00/66741 A2 | 11/2000 |
| WO | WO-0066791 | 11/2000 |
| WO | WO-0071725 | 11/2000 |
| WO | WO-0155182 | 1/2001 |
| WO | WO-0131019 | 5/2001 |
| WO | WO-0152885 | 7/2001 |
| WO | WO 01 64920 A | 9/2001 |
| WO | WO 01/64922 | 9/2001 |
| WO | WO 02 079242 A | 10/2002 |
| WO | WO 03/009869 | 2/2003 |
| WO | WO-03020756 | 3/2003 |
| WO | WO-03/063766 | 8/2003 |
| WO | WO-2004032958 | 4/2004 |
| WO | WO-2004048404 | 6/2004 |
| WO | WO-2004/065603 A2 | 8/2004 |
| WO | WO-2004/094596 A2 | 11/2004 |
| WO | WO-2006024954 | 3/2006 |
| WO | WO-2006/081259 | 8/2006 |
| WO | WO-2007/060548 A2 | 5/2007 |
| WO | WO-2007/127665 A2 | 11/2007 |
| WO | WO-2008/125985 A2 | 10/2008 |
| WO | WO-2008/149238 A2 | 12/2008 |
| WO | WO-2009/104097 A2 | 8/2009 |
| WO | WO-2010/028859 A1 | 3/2010 |
| WO | WO-2010/046715 A1 | 4/2010 |

OTHER PUBLICATIONS

Greenspan et al. (Nature Biotechnology 7: 936-937, 1999).*
Greenbaum et al, Journal of Molecular Recognition, 20(2):75-82, 2007.*
Blythe et al, Protein Science 14:246-248, 2005.*
Tettelin H. et al. (Mar. 10, 2000). "Complete Genome Sequence of *Neisseria meningitidis* Serogroup B Strain MC58," Science 287: 1809-1815.
Guillen G. et al, "Expression in *Escherichia coli* and Immunological Charaterization of a Hybrid . . . " Biotecnologia Aplicada, Oct. 1, 1996, vol. 13, Issue No. 4, Bioline Intl.
DATABASE EMBL "*Neisseria meningitidis* ORF 936" XP002390341 Database Accession No. AAY75704 Seq. ID 2880 of WO9957280.
Ashton et al. (1983). "Immunogenic and protective properties of meningococcal serotype 2a protein in the hen-embryo model," J Med Microbiol 16(4):443-57.
Database accession No. NMB1994.Tettelin et al. (Mar. 2, 2010).
Pannekoek (1995). "Construction of recombinant neisserial Hsp60 proteins and mapping of antigenic domains," Mol Microbiol 5(2):277-85. (Abstract).
Pettersson et al. (1993). "Molecular Characterization of the 98-Kilodalton Iron-Regulated Outer Membrane Protein of *Neisseria meningitidis*," Infection and Immunity 61(11):4724-4733.
Hou et al. (2005). "Protective Antibody Responses Elicited by a Meningococcal Outer Membrane Vesicle Vaccine with Overexpressed Genome-Derived Neisserial Antigen 1870," J Infect Dis 192(4):580-90.
Zhu et al. (2005). "Evaluation of Recombinant Lipidated P2086 Protein as a Vaccine Candidate for Group B *Neisseria meningitidis* in a Murine Nasal Challenge Model," Infect Immun 73(10):6838-45.
Aasel et al. (1998). Abstract from the 11th International Pathogenic *Neisseria* Conference, Nice France, Nov. 1-6, 1998. pp. 37-38.
Bernfield L. et al. (Sep. 2002). "Identification of a novel vaccine candidate for group B *Neisseria meningitidis*," Thirteenth International Pathogenic *Neisseria* Conference, Norwegian Institute of Public Health, Oslo, Norway, pp. 116.
Cannon (1989). "Conserved Lipoproteins of Pathogenic *Neisseria* Species Bearing the H.8 Epitope: Lipid-Modified Azurin and H.8 Outer Membrane Protein," Clinical Microbiology Reviews, vol. 2, Suppl., S1-S4.
Cantini et al. (Mar. 2006). "Solution Structure of the Immunodominant Domain of Protective Antigen GNA 1870 of *Neisseria meningitidis*," Journal of Biological Chemistry 281(11): 7220-7227.
Feavers et al. (2009). "Meningococcal protein antigens and vaccines," Vaccine 275:B42-B50.
Fleischmann et al. (1995). "Whole-Genome Random Sequencing and Assembly of *Haemophilus influenzae* Rd," Science 269:496-501.
Fletcher et al. (2004). "Vaccine Potential of the *Neisseria meningitidis* 2086 Lipoprotein," Infection and Immunity 72(4): 2088-2100.
Fontana et al. (2002). "A genomic approach to identify vaccine candidates against gonococcus." Abstract from the 13th International Pathogenic *Neisseria* Conference, Oslo, Norway, Sep. 1-6, 2002. p. 248.
Giuliani et al. (2006). "A universal vaccine for serogroup B meningococcus," PNAS 103(29):10834-10839.
Giuliani et al. (Feb. 2005). "The Region Comprising Amino Acids 100 to 255 of *Neisseria meningitidis* Lipoprotein GNA 1870 Elicits Bactericidal Antibodies," Infection and Immunity 73(2): 1151-1160.
JCVI-CMR website showing Z2491 Sanger sequence (http://cmr.jcvi.org/tigr-scripts/CMR/shared/Genomes.cgi and links).
Masignani V. (Mar. 17, 2003). "Vaccination against *Neisseria meningitidis* using three variants of the lipoprotein GNA1870," J. Exp. Med. 197(6):789-799.
Morley, S. et al. (Dec. 12, 2001). "Vaccine prevention of meningococcal disease, coming soon?" Vaccine 20(5-6):666-687.
Nassif (2000). "A Furtive Pathogen Revealed," Science 287: 1767-1768.
Phase II clinical results for Novartis vaccine, Oct. 9, 2008.
Post by Dr. Parkhill on BIOSCI/Bionet of May 8, 1998.
Progress through the Sanger Institute FTP server. FTP root at ftp.sanger.ac.uk.
PSORT analysis of 200 of the sequences disclosed in PCT/US99/09346 (i.e., the original application underlying the Patent; published as W099/057280).
PSORT analysis of SEQ ID Nos. 4 and 6, and of 'Contig295' 300mer.
PSORT prediction result for SEQ ID No: 2.
Response to Communication, filed in EP Application No. 07075161. 5. Oct. 28, 2009.
Rinaudo et al. (2009). "Vaccinology in the genome era", The Journal of Clinical Investigation, 119(9):2515-2525.
Romero et al. (1994). "Current status of Meningococcal group B vaccine candidates: capsular or noncapsular?" Clin. Microbiol. Rev. 7(4):559-575.
Sanger Centre's "Projects" website as of Dec. 10, 1997 as retrievable via http://web.archive.org.
Sequence for "Putative Lipoprotein [*Neisseria meningitidis* Z2491]," NCBI Reference Sequence: YP_002342062.1, Mar. 30, 2000.
Serruto et al. (2009). "Genome-based approaches to develop vaccines against bacterial pathogens," Vaccine 27:3245-3250.
Supplementary Declaration by Dr. Julian Parkhill, dated May 10, 2010.
Telford et al. (2003). "Genomic and Proteomics in Vaccine Design," in New Bacterial Vaccines, edited by Ellis et al. Kleweur Academic/Plenum Publishers, USA. pp. 1-11 (2 pages).
U.S. Appl. No. 60/098,685, "*Neisseria* Spp, Polypeptide, Gene Sequence And Uses Thereof," filed Sep. 1, 1998.
Welsch et al. (2004). "Protective Activity of Monoclonal Antibodies to Genome-Derived Neisserial Antigen 1870, a *Neisseria meningitidis* Candidate Vaccine," The Journal of Immunology 172: 5606-5615.
Zollinger (1997). "New and Improved Vaccines Against Meningococcal Disease" in New Generation Vaccines, 2nd Ed., edited by Levine et al., Marcel Dekker, New York. pp. 469-488.
Notice of Opposition against European Patent EP 1645631, granted on Oct. 24, 2007 Opposition filed on Jul. 23, 2008. 20 pages.
Supplemental Submissions in Opposition against European Patent EP 1645631, granted on Oct. 24, 2007. Opposition filed on May 25, 2010. 28 pages.
Patentees' Response to Opposition against European Patent EP 1645631, granted on Oct. 24, 2007. 13 pages.
1997-11-17-NM_shotgun.dbs and Dec. 15, 1997-NM.dbs, located at <ftp://ftp.sanger.ac.uk/pub/pathogens/nm/old data/>.
Declaration by Dr. Julian Parkhill dated Jun. 12, 2008. 2 pages.
Farley J. at al. (Sep. 2002). "Characterization, cloning and expression of different subfamilies of the ORF 2086 gene from *Neisseria*

(56) References Cited

OTHER PUBLICATIONS

*meningitidis*," Thirteenth International Pathogenic *Neisseria* Conference, Norwegian Institute of Public Health, Oslo, Norway, p. 124.
Pizza et al. (2000). "Identification of Vaccine Candidates Against Serogroup B Meningococcus by Whole-Genome Sequencing," Science 287(5459):1816-1820.
The printed output from the NCBI open reading frame finder (12 pages).
United States Office Action mailed on Feb. 11, 2009, for U.S. Appl. No. 10/181,600 filed Jan. 17, 2001, 5 pages.
United States Office Action mailed on Jul. 24, 2008, for U.S. Appl. No. 10/181,600 filed Jan. 17, 2001, 23 pages.
United States Office Action mailed on Jul. 7, 2009, for U.S. Appl. No. 10/181,600 filed Jan. 17, 2001, 23 pages.
Aderson et al. (2010). "Effectiveness of a bivalent factor H binding protein vaccine across Neisseria meningitidis serogroups," 17th International Pathogenic Neisseria Conference 2010, p. 196.
Ala'Aldeen et al. (2010) "Human antibody response to the meningococcal factor H binding protein (LP2086) during invasive disease, colonization and carriage," Vaccine 28:7667-75.
Ambrose et al. (2006). "Characterization of LP2086 expression in Neisseria meningitidis," 15th International Pathogenic Neisseria Conference 2006, p. 103.
Anderson et al. (2008). "Functional cross-reactive antibodies are elicited by a group B Neisseria meningitidis bivalent recombinant lipidated LP2086 vaccine in cynomolgusmacaques," 16th International Pathogenic Neisseria Conference (IPNC) P100, pp. 170-171.
Anderson et al. (2009). "Development of a factor H binding protein vaccine for borad protection against invasive Neisseria meningitidis serogroup B (MnB) disease," 10th European Meningococcal Disease Society Congress 2009, p. 39.
Anderson et al. (2009). "Epidemiology of the serogroup B Neisseria meningitidis (MnB) factor H binding protein and implications for vaccine development," European Society for Paediatric Infectious Disease Symposium 2009, p. 505.
Anderson et al. (2012). "Potential impact of the bivalent rLP2086 vaccine on Neisseria meningitidis invasive disease and carriage isolates in two adolescent populations," European Society for Paediatric Infectious Disease Symposium 2012, p. 807.
Anderson et al. (2013) "Potential impact of the bivalent rLP2086 vaccine on Neisseria meningitidis carriage and invasive serogroup B disease," Hum Vacc Immunotherap 9:471-9.
Appendix I to Statement of Grounds of Appeal filed by df-mp on Sep. 28, 2012, in relation to EP1645631, 1 pages.
Appendix II to Statement of Grounds of Appeal filed by df-mp on Sep. 28, 2012, in relation to EP1645631, 2 pages.
Beernick (Jul. 2010) "Impaired immunogenicity of a meningococcal factor H-binding protein vaccine engineered to eliminate factor h binding," Clin Vac Immunol 17(7):1074-1078.
Beernik et al (Jul. 2006). "Rapid Genetic Grouping of Factor H-Binding Protein (Genome-Derived Neisserial Antigen 1870), a Promising Group B Meningococcal Vaccine Candidate," Clinical and Vaccine Immunology 13(7):758-763.
Beernik et al. (Jun. 2008). "Bactericidal antibody responses, induced by meningococcal recombinant chimeric factor H-binding protein vaccines," Infection and Immunity 76(6):2568-2575.
Beernik et al. (Sep. 2008). "Fine antigenic specificity and cooperative bactericidal activity of monoclonal antibodies directed at the meningococcal vaccine candidate factor h-binding protein," Infection and Immunity 76(9):4232-4240.
BenMohamed et al. (2002). "Lipopeptide vaccines-yesterday, today, and tomorrow," Lancet 2(7):425-431.
Bentley et al. (2004). Identification of two immunologically distinct domains on the LP2086 outer membrane lipoprotein of Neisseria meningitidis, 14th International Pathogenic Neisseria Conference 2004, p. 144.
Borrow and Carlone. 2001. Serogroup B and C bactericidal assays, p289-304. In A. Pollard and M. Maiden (ed.), Meningococcal vaccines. Humana Press, Totowa, NJ.
Borrow R, Balmer P, Miller E. Meningococcal Surrogates of Protection—Serum Bactericidal Activity. Vaccine 2005;23:2222-2227.
Bouvier et al. (1991). "A gene for a new lipoprotein in the dapA-purC interval of the *Escherichia coli* chromosome," J Bacteriol 173(17):5523-5531.
Chen, et al. (1994). "Determination of the optimal aligned spacing between the Shine-Dalgarno sequence and the translation initiation codon of *Escherichia coli* mRNAs," Nucleic Acids Res. 22(23):4953-4957.
Clinical Trial No. NCT00500032, (2007). "Blood collection for use in serological assay development from healthy adult volunteers," U.S. National Institutes of Health, retrieved online at <http://clinicaltrials.gov/ct2/show/NCT00500032?term=NCT00500032&rank=1>.
Clinical Trial No. NCT00808028, (2008). "A study evaluating safety and immunogenicity of meningococcal B rIp2086 vaccine in adolescents," U.S. National Institutes of Health, retrieved online at <http://clinicaltrials.gov/ct2/show/NCT00808028?term=NCT00808028&rank=1>.
Cohn et al. (2010). "Potential Impact of Serogroup B Vaccines: Prevalence of candidate vaccine antigens among invasive *Neisseria meningitidis* isolates in the United States," 17th International Pathogenic Neisseria Conference 2010, p. 77.
Cordis, "Preparation of meningococcal antigens," posted online on Feb. 2, 2005, 2 pages.
Cruse et al. (2003). Illustrated Dictionary of Immunology, $2^{nd}$ Ed. CRC Press, pp. 46, 166, and 382.
Declaration by Dr. Ellen Murphy, Ph.D., dated Sep. 14, 2011, submitted in opposition proceedings for EP1645631, 4 pages.
Declaration by E. Richard Moxon dated Feb. 16, 2013, submitted in opposition proceedings for EP1645631, 5 pages.
Declaration by Emilio A. Emini, Ph.D., dated Nov. 2, 2011, submitted in opposition proceedings for EP1645631, 5 pages.
Declaration by Isabel Delany, dated Feb. 18, 2013, submitted in opposition proceedings for EP1645631, 5 pages.
Declaration by Prof. Paul Dunman, Ph.D., dated Sep. 25, 2012, submitted in opposition proceedings for EP1645631, 14 pages.
Declaration by Rino Rappuoli, dated Oct. 13, 2011, submitted in opposition proceedings for EP1645631, 5 pages.
Declaration by Vega Masignani dated Feb. 18, 2013, submitted in opposition proceedings for EP1645631, 4 pages.
Delgado et al. (2007). "Lipoprotein NMB0928 from *Neisseria meningitidis* serogroup B as a novel vaccine candidate," Vaccine 25:8420-8431.
Dinthilhac and Claverys (1997). "The adc locus, which affects competence for genetic transformation in *Streptococcus pneumoniae*, encodes an ABC transporter with a putative lipoprotein homologous to a family of streptococcal adhesins," Res Microbiol 148:119-131.
Dlawer et al. (2010). "Human antibody responses to the meningococcal factor H binding protein LP2086 during invasive disease," 17th International Pathogenic Neisseria Conference 2010, p. 130.
European Medicines Agency, (Nov. 16, 2012). "European Medicines Agency recommends approval of first vaccine for meningitis B," Press Release, 2 pages.
Facts and Submissions dated May 21, 2012, in relation to EP1645631, 30 pages.
Fraser et al. (1997). "Genomic sequence of a lyme disease spirochaete, *Borrelia burgdorferi*," Nature 390:580-586.
Fraser et al. (1998). "Complete genome sequence of *Treponema pallidum*, the syphilis spirochete," Science 281:375-388.
GenPept accession No. AAF42204, "hypothetical protein NMB1870 [*Neisseria meningitidis* MC58]," retrieved on Sep. 26, 2012, 2 pp.
Giuliani et al. (2010). "Measuring antigen-specific bactericidal responses to a multicomponent vaccine against serogroup B meningococcus," Vaccine 28:5023-5030.
Gold and Stormo (1987). "Translation Initiation", in *Escherichia* con and *Salmonella* typhimurium, Cellular and Molecular Biology, Ed. Neidhardt, pp. 1302-1307.
Goldschneider I, Gotschlich EC, Artenstein MS. (1969) Human immunity to the meningococcus. I. The role of humoral immunity. J Exp Med 129:1307-1326.

(56) References Cited

OTHER PUBLICATIONS

Goldschneider I, Gotschlich EC, Artenstein MS. (1969) Human immunity to the meningococcus. II. Development of natural immunity. J Exp Med 129:1327-1348.

Gorringe et al. (2009). "16th International Pathogenic Neisseria Conference: recent progress towards effective meningococcal disease vaccines," Human Vaccines 5(2):53-56.

Grandi (2005). "Reverse vaccinology: a critical analysis," in Encyclopedia of Genetics, Genomics, Proteomics and Bioinformatics, pp. 1322-1326.

Granoff, DM. (2009). Relative importance of complement-mediated bactericidal and opsonic activity for protection against meningococcal disease. Vaccine 27(Supplement 2): B117-B125.

Harris et al. (2008). "Development and qualification of serum bactericidal assays for *Neisseria meningitidis* serogroup B," 16th International Pathogenic *Neisseria* Conference 2008, p. 268-269.

Harris et al. (2010). "Robustness of the Serum Bactericidal Activity (SBA) Assay for *Neisseria meningitidis* serogroup B," 17th International Pathogenic *Neisseria* Conference 2010, p. 169.

Harris et al. (2011) "Preclinical evidence for the potential of a bivalent fHBP vaccine to prevent *Neisseria meningitidis* serogroup C disease," Human Vaccines 7:1 (suppl) 1-7.

Hayashi and Wu, "Identification and characterization of lipid-modified proteins in bacteria," Chapter 10 in Lipid Modifications of Proteins: A Practical Approach, Hooper and Turner (eds.), published in 1992, 27 pages.

Hem et al. (1995). "Structure and properties of aluminum-containing adjuvants," Vaccine Design. Subunit and Adjuvant Approach, pp. 249-276.

Hodge et al. (2006). "Development of a luminex-based meningococcal rLP2086-specific human IgG assay," 15th International Pathogenic *Neisseria* Conference 2006, p. 113.

Hoiseth et al. (2008). "LP2086 and MLST distribution in epidemiologically relevant strains of serogroup B *Neisseria meningitidis*," 16th International Pathogenic *Neisseria* Conference 2008, p. 205.

Hung et al. (2011). "The *Neisseria meningitidis* macrophage infectivity potentiator protein induces cross-strain serum bactericidal sctivity and is a potential serogroup B vaccine candidate," Infect Immun 79(9):3784-3791.

Jacobsson et al. (2009). "Prevalence and sequence variations of the genes encoding the five antigens included in the novel 5CVMB vaccine covering group B meningococcal disease" Vaccine. 27:1579-1584.

Jansen et al. (2008). "Bivalent recombinant LP2086 vaccine to provide broad protection against *Neisseria meningitidis* B disease: immunological correlates of protection and how to assess coverage against invasive MnB strains," 16th International Pathogenic *Neisseria* Conference 2008, p. 80-81.

Jansen et al. (2009). "Development of a bivalent factor H binding protein vaccine to broadly protect against invasive *Neisseria meningitides* serogroup B (MnB) disease," European Society for Paediatric Infectious Disease Symposium 2009, p. 311.

Jansen et al. (2010). "Estimating effectiveness for *Neisseria meningitidis* serogroup B (MnB) vaccine candidates composed of non-serogroup specific antigens," 17th International Pathogenic *Neisseria* Conference 2010, p. 37.

Jansen et al. (2011). "Monitoring the Breadth of Coverage of Meningococcal Vaccines: An Overview and Progress Update on the Pfizer Bivalent LP2086 Vaccine Program," 14th Annual Conference on Vaccine Research, 2011, p. 74.

Jiang et al. (2003). "Using rate of acid neutralization to characterize aluminum phosphate adjuvant," Pharma Dev Tech 8(4):349-356.

Jiang et al. (2006). "Serum IgG response induced by a bivalent recombinant LP2086 provides broad protection against serogroup B *Neisseria meningitidis*," 15th International Pathogenic *Neisseria* Conference 2006, p. 113.

Jiang et al. (2008). "Prediction of broad vaccine coverage for a bivalent rLP2086 based vaccine which elicits serum bactericidal activity against a diverse collection of serogroup B meningococci," 16th International Pathogenic *Neisseria* Conference 2008, p. 57-58.

Jiang et al., (2010) "Broad vaccine coverage predicted for a bivalent recombinant factor H binding protein based vaccine to prevent serogroup B meningococcal disease" Vaccine 28:6086-6093.

Johnson et al. (1999). "Analysis of the human Ig isotype response to lactoferrin binding protein A from *Neisseria meningitidis*," Fems Immun. Med. Microbial. 25(4): 349-354.

Jones et al. (2005). "Effects of adsorption to aluminum salt adjuvants on the structure and stability of model protein antigens," J Biol Chem 280(14):13406-13414.

Jones et al. (2009). "Generation of human serum complement lots that perform consistently for use in *Neisseria meningitidis* serogroup B (MnB) vaccine clinical trials," European Society for Paediatric Infectious Disease Symposium 2009, p. 566.

Juncker et al. (2003). "Prediction of lipoprotein signal peptides in gram-negative bacteria," Protein Sci 12:1652-1662.

Klein et al. (2000). "Analysis of aluminum hydroxyphosphate vaccine adjuvants by 27Al MAS NMR," J Pharma Sci 89(3):311-321.

Koeberling et al. (2009). "Meningococcal outer membrane vesicle vaccines derived from mutant strains engineered to express factor H binding proteins from antigenic variant groups 1 and 2," Clin Vac Immunol, 16(2):156-162.

Liebl et al. (1997). "Properties and gene structure of the *Thermotoga maritima* alpha-amylase AmyA, a putative lipoprotein of a hyperthermophilic bacterium," J Bacteriol 179(3):941-948.

Lucidarme et al., (Sep. 16, 2009) "Characterization of fHbp, nhba (gna2132), nadA, porA, sequence type (ST), and genomic presence of IS1301 in group B meningococcal ST269 clonal complex isolates from England and Wales" Journal of Clinical Microbiology, 47(11):3577-85.

Lucidarme et al., 2010 "Characterization of fHbp, nhba (gna2132), nadA, porA, and sequence type in group B meningococcal case isolates collected in England and Wales during Jan. 2008 and potential coverage of an investigational group B meningococcal vaccine" Clinical and Vaccine Immunology 17(6):919-929.

Marshall et al. (2008). "A randomized, placebo-controlled, double-blind, phase 1 trial of ascending doses of meningococcal group B rLP2086 vaccine in healthy adults," 16th International Pathogenic *Neisseria* Conference 2008, p. 271-272.

Marshall et al. (2011). "Phase I randomised controlled clinical trial of safety and immunogenicity of a meningococcal B bivalent LP2086 vaccine in healthy toddlers," European Society for Paediatric Infectious Disease Symposium 2011, p. 189.

Marshall et al. (2012) "Safety and immunogenicity of a meningococcal B bivalent rLP2086 vaccine in healthy toddlers aged 18-36 months: A phase 1 randomized-controlled clinical trial," Ped Infect Dis J 31:1061-8.

Marshall et al. (2013) "A phase 2 open-label safety and immunogenicity study of a meningococcal B bivalent rLP2086 vaccine in healthy adults," Vaccine 31:1569-75.

Mascioni et al. (2008). "Determination of the domain and solution structure of rLP2086, a meningococcal vaccine candidate and human factor H binding protein," 16th International Pathogenic *Neisseria* Conference 2008, p. 77-78.

Mascioni et al. (2009) "Structural basis for the immunogenic properties of the meningococcal vaccine candidate LP2086," J Biol Chem 284:8738-46.

Mascioni et al. (2010) "NMR dynamics and antibody recognition of the meningococcal lipidated outer membrane protein LP2086 in micellar solution," Biochim Biophys Acta 1798:87-93.

McNeil et al. (2009) "Detection of LP2086 on the cell surface of *Neisseria meningitidis* and its accessibility in the presence of serogroup B capsular polysaccharide," Vaccine 27:3417-21.

McNeil et al. (2010) "Anti-fHBP antibodies elicited after immunization with a recombinant fHBP vaccine candidate (rLP2086) can displace human Factor H from the surface of Serogroup B Meningococci," 17th International Pathogenic *Neisseria* Conference 2010, p. 94.

McNeil et al. (2013) "Role of factor H binding protein in *Neisseria meningitidis* virulence and its potential as a vaccine candidate to broadly protect against meningococcal disease," Microbiol Mol Biol Rev 77:234.

(56) References Cited

OTHER PUBLICATIONS

Milagres et al. (1998). "Specificity of bactericidal antibody response to serogroup B meningococcal strains in Brazilian children after immunization with an outer membrane vaccine," Infection and Immun. 66(10): 4755-4781.
Milagres, L. G., S. R. Ramos, C. T. Sacchi, C. E. A. Melles, V. S. D. Vieira, H. Sato, G. S. Brito, J. C. Moraes, and C. E. Frasch. 1994. Immune response of Brazilian children to a *Neisseria meningitidis* serogroup B outer membrane protein vaccine: comparison with efficacy. Infect. Immun. 62(10):4419-4424.
Munkley, et al. (1991). "Blocking of bactericidal killing of *Neisseria meningitidis* by antibodies directed against slacc 4 outer membrane proteins," Microbial Pathogenesis 11: 447-452.
Murphy et al. (2008). "Sequence diversity of vaccine candidate LP2086 in *Neisseria meningitidis* serogroup B strains causing invasive disease," 16th International Pathogenic *Neisseria* Conference 2008, p. 61.
Murphy et al. (2010). "Prevalence of Factor H Binding Protein (fHBP) Variants in *N. meningitidis* Carriage Isolates," 17th International Pathogenic *Neisseria* Conference 2010, p. 96.
Murphy et al., (2009) "Sequence diversity of the factor H binding protein vaccine candidate in epidemiologically relevant strains of serogroup B *Neisseria meningitidis*" J Infect Dis 200:379-389.
Novartis (Jan. 22, 2013) "Novartis receives EU approval for Bexsero®, first vaccine to prevent the leading cause of life-threatening meningitis across Europe," Media Release, 3 pages.
Pajon et al. (2010). "Frequency of factor H-binding protein modular groups and susceptibility to cross-reactive bactericidal activity in invasive meningococcal isolates" Vaccine 28:2122-2129.
Pajon et al. (2012). "Design of meningococcal factor H binding protein mutant vaccines that do not bind human complement factor H," Infect Immun 80:2667-2677.
Pettersson, et al. (2006). "Vaccine potential of the *Neisseria meningitidis* lactoferrin-binding proteins LbpA and LbpB," Vaccine 24(17):3545-3557.
Pillai et al. (2005) "Outer membrane protein (OMP) based vaccine for *Neisseria meningitidis* serogroup B," Vaccine 23(17-18):2206-2209.
Pizza et al. (2008) "Factor H-binding protein, a unique meningococcal vaccine antigen" Vaccine 26S:I46-8.
Prosite, "ScanProsite Results Viewer: USERSEQ1 (280aa)," retrieved on Jun. 21, 2012, 1 page.
Pugsley (1993). "The complete general secretory pathway in gram-negative bacteria," Microbiological Rev 5(1):50-108.
Response to Appeal filed by Carpmaels & Ransford on Feb. 18, 2013, in relation to EP1645631, 21 pages.
Response to Appeal filed by df-mp on Feb. 18, 2013, in relation to EP1645631, 28 pages.
Richmond et al. (2008). "A randomized, observer-blinded, active control, phase 1 trial of meningococcal serogroup B rLP2086 vaccine in healthy children and adolescents aged 8 to 14 years," 16th International Pathogenic *Neisseria* Conference 2008, p. 270-271.
Richmond et al. (2010). "Safety & immunogenicity of serogroup B *Neisseria meningitidis* (MnB) rLP2086 vaccine in adults and adolescent subjects: overview of 3 clinical trials," 17th International Pathogenic *Neisseria* Conference 2010, p. 37.
Richmond et al. (2011). "Phase II randomised controlled trial of safety and immunogenicity of a meningococcal B bivalent vaccine (rLP2086) in healthy adolescents," European Society for Paediatric Infectious Disease Symposium 2011, p. 192.
Richmond et al. (2012) "A bivalent *Neisseria meningitidis* recombinant lipidated factor H binding protein vaccine in young adults: Results of a randomized, controlled, dose-escalation phase 1 trial," Vaccine 30(43):6163-74.
Richmond et al. (2012a) "Safety, immunogenicity, and tolerability of meningococcal serogroup B bivalent recombinant lipoprotein 2086 vaccine in healthy adolescents: a randomized, single-blind, placebo-controlled, phase 2 trial," Lancet Infect Dis 12:597-607.

Scarselli et al. (Feb. 13, 2009). "Epitope Mapping of a Bactericidal Monoclonal Antibody against the Factor H Binding Protein of *Neisseria* meningitides," Journal Of Molecular Biology 386(1):97-108.
Schneider et al. (Apr. 16, 2009) "*Neisseria meningitidis* recruits factor H using protein mimicry of host carbohydrates," Nature 458(7240):890-893.
Seeber et al. (1991). "Predicting the adsorption of proteins by aluminum-containing adjuvants," Vaccine 9(3):201-203.
Seib et al. (2010). "Influence of serogroup B meningococcal vaccine antigens on growth and survival of the mengococcus in vitro and in ex vivo and in vivo models of infection," Vaccine 28(12):2416-2427.
Sheldon et al. (2011). "Phase 1, Randomized, Open-Label, Study to Assess the Safety and Immunogenicity of Serogroup B *Neisseria Meningitidis* (Mnb) rLP2086 Vaccine in Healthy Adults," 14th Annual Conference on Vaccine Research, 2011, p. 59-60.
Sheldon et al. (2012) "A phase 1, randomized, open-label, active-controlled trial to assess the safety of a meningococcal serogroup B bivalent rLP2086 vaccine in healthy adults," Hum Vacc Immunotherap 8:1-8.
Shevchik et al. (1996). "Characterization of pectin methylesterase B, an outer membrane lipoprotein of Erwinia chrysanthemi 3937," Mole Microbiol 19(3):455-466.
Statement of Grounds of Appeal filed by Carpmaels & Ransford on Oct. 4, 2012, in relation to EP1645631, 9 pages.
Statement of Grounds of Appeal filed by df-mp on Sep. 28, 2012, in relation to EP1645631, 54 pages.
Supplementary declaration by Ellen Murphy dated Sep. 26, 2012, submitted in opposition proceedings for EP1645631, 3 pages.
Supplementary declaration by Prof. Paul Dunman, Ph.D., dated Sep. 25, 2012, submitted in opposition proceedings for EP1645631, 14 pages.
Sutcliffe and Russell (1995). "Lipoproteins of gram-positive bacteria," J Bacteriol 177(5):1123-1128.
Tan et al. (2010). "Advances in the development of vaccines against *Neisseria meningitidis*," NEJM 362(16):1511-1520.
TIGR website as of 1998, 8 pages.
von Heijne (1989). "The structure of signal peptides from bacterial lipoproteins," Protein Engineering 2(7):531-534.
Wang et al. (2010). "Prevalence and genetic diversity of candidate vaccine antigens among invasive *Neisseria meningitidis* isolates in the United States," 17th International Pathogenic *Neisseria* Conference 2010, p. 122.
Welsch et al. (2007) "A novel mechanism for complement-mediated killing of encapsulated *Neisseria meningitidis* elicited by monoclonal antibodies to factor H-binding protein (genome-derived Neisserial antigen 1870)" Molecular Immunology 44(1-3):256.
Welsch et al. (Apr. 1, 2008). "Complement-dependent synergistic bactericidal activity of antibodies against factor H-binding protein, a sparsely distributed meningococcal vaccine antigen," J Infect Dis 197(7):1053-1061.
Woods, et al. (1987). "Resistance to meningococcemia apparently conferred by anti-H.8 monoclonal antibody is due to contaminating endotoxin and not to specific immunoprotection," Infection and Immunity 55(8):1927-1928.
Wu et al. (1996). "A protein class database organized with ProSite protein groups and PIR superfamilies," J Comp Biol 3(4):547-561.
York et al. (2010). "fHBP epidemiology of invasive meningococcal B isolates from Spain and Germany: age based," 17th International Pathogenic *Neisseria* Conference 2010, p. 109.
Zhu et al. (2004). "Evaluation of the purified recombinant lipidated P2086 protein as a vaccine candidate for group B *Neisseria meningitidis* in a murine nasal challenge model," 14th International Pathogenic *Neisseria* Conference 2004, p. 199.
Zhu et al. (2006) "Intranasal immunization of mice with recombinant lipidated P2086 protein reduces nasal colonization of group B *Neisseria meningitidis*," Vaccine 24:5420-5.
Zhu et al. (2006). "Effective immunization strategy against group B *Neisseria meningitidis* using purified recombinant lipidated P2086 protein," 15th International Pathogenic *Neisseria* Conference 2006, p. 47.
Zlotnick et al. (2009). "Epidemiology of the serogroup B *Neisseria meningitidis* (MnB) factor H binding protein in strains sampled from

(56) References Cited

OTHER PUBLICATIONS

Spain and Germany in the years 2001-2006," 10th European Meningococcal Disease Society Congress 2009, p. 81.
Zlotnick et al. (2010). "Biochemical and biophysical analysis indicates conformation plays an important role in the binding of hfH and antibodies to the fHBP of *N. meningitidis*," 17th International Pathogenic *Neisseria* Conference 2010, p. 38.
Adams (1996). "Should Non-Peer-Reviewed Raw DNA Sequence Data Release Be Forced on the Scientific Community?," Science, 274: 534-536.
Biswas et al. (1995). "Characterization of IbpA, the structural gene for a lactoferrin receptor in *Neisseria gonorrhoeae*," Infection and Immunity, 63(8): 2958-2967.
Blattner et al. (1997). "The complete genome sequence of *Escherichia coli* K-12," Science 277 (5331):1453-1474.
Database UniProt (Oct. 1, 2000), "SubName: Full=Uncharacterized protein" retrieved from EBI, accession no. Q9JXV4 Database accession No. Q9JXV4.
Decision revoking the European Patent, filed in opposition against EP1976990, dated Nov. 11, 2013, 15 pages.
Decision to refuse a patent application, filed in the Opposition against EP1645631, dated Apr. 28, 2009, 7 pages.
Declaration by Dr. Julian Parkhill, filed in the Opposition against EP1645631, dated Jul. 10, 2014, 5 pages.
Declaration by Ellen Murphy, filed in the Opposition against EP1645631, dated May 12, 2014, 3 pages.
Elzanowski et al. (2013). "The Genetic Codes, a compilation," Retrieved from http://www.bioinformatics.org/JaMBW/2/3/TranslationTables.html.
Experimental data: expression of NspA, '287' and '741' on 3 strains of bacteria, filed in opposition against EP1534326, dated Aug. 4, 2010, 2 pages.
Gene Browser, Nature Technology Corporation, filed in the Opposition against EP1645631, dated Jun. 26, 2013, 6 pages.
Hoist et al. (2014). "Variability of genes encoding surface proteins used as vaccine antigens in meningococcal endemic and epidemic strain panels from Norway," Vaccine 32:2722-2731.
Interlocutory decision in opposition proceedings, filed in the Opposition against EP1645631, dated May 21, 2012, 82 pages.
Koeberling et al. (2008). "Bactericidal antibody responses elicited by a meningococcal outer membrane vesicle vaccine with overexpressed factor H-binding protein and genetically attenuated endotoxin," J. Infect. Dis., 198(2):262-270.
Kovacs-Simon et al. (2011). "Lipoproteins of Bacterial Pathogens," Infect Immun 79(2):548-561.
Lewis et al. (2010). "The meningococcal vaccine candidate neisserial surface protein A (NspA) binds to factor H and enhances meningococcal resistance to complement," PLoS Pathogens 6(7):e1001027.
Liechti et al. (2012). "Outer membrane biogenesis in *Escherichia coli*, *Neisseria meningitidis*, and *Helicobacter pylori*: paradigm deviations in *H. pylori*," Front Cell and Infect Microbiol 2:article 29.
Lindblad, (2004). "Aluminium compounds for use in vaccines," Immunol Cell Biol.,82(5):497- 505.
Madico et al. (2006). "The meningococcal vaccine candidate GNA1870 binds the complement regulatory protein factor H and enhances serum resistance," J Immunol 177(1):501-510.
Cole et al. (1998). "Deciphering the biology of *Mycobacterium tuberculosis* from the complete genome sequence," Nature 394:651-653.
Meyer et al. (1984). "Pilus genes of *Neisseria gonorrheae*: Chromosomal organization and DNA sequence," Proc. Nail. Acad. Sci. USA 81: 6110-6114.
Minutes of the oral proceedings, filed in the Opposition against EP1645631, dated Feb. 11, 2014, 4 pages.
Notice of Opposition against EP 1562983, filed on Jul. 1, 2014, 23 pages.
Notice of Opposition against EP1645631, filed in the Opposition against EP1645631, dated Jul. 23, 2008, 25 pages.
Notice of Opposition filed May 24, 2012, filed in opposition against EP1976990, 19 pages.
Novartis (Jun. 9, 2011). "Novartis candidate vaccine Bexsero® shows significant potential in providing broad coverage against meningococcal serogroup B infections." Media Release, 6 pages.
Opponent's Further Submission in Preparation of the Oral Proceedings, filed in the Opposition against EP1645631, dated Nov. 3, 2011, 6 pages.
Opponent's Response to the Patentee's Submission dated Feb. 18, 2013, filed in the Opposition against EP1645631, dated Jul. 24 2014, 34 pages.
Opponents Final Written Submission in Preparation of Oral Proceedings, filed in the Opposition against EP1645631, dated Sep. 14, 2011, 28 pages.
ORF Finder (2013). "Bacterial Code," Retrieved from http://www.ncbi.nlm.nih.gov/gorf/gorf.html, 3 pages.
Patentee's Submissions under Rule 116 EPC, filed in the Opposition against EP1645631, dated Sep. 13, 2011, 13 pages.
Seib et al. (2011). "Characterization of Diverse Subvariants of the Meningococcal Factor H (fH) Binding Protein for Their Ability To Bind fH, To Mediate Serum Resistance, and To Induce Bactericidal Antibodies," Infect Immun, 79(2):970-81.
Sprengart et al. (1997). "Functional importance of RNA interactions in selection of translation initiation codons," Molecular Microbilogy, 24(1):19-28.
Submission of the Patentee of Jul. 6, 2012, filed Jun. 24, 2014, in the Opposition against EP1645631, 4 pages.
Summons to oral proceedings pursuant to Rule 115(1) EPC, filed in the Opposition against EP1645631, dated Nov. 11, 2013, 12 pages.
Supplementary Submission to the Grounds of Appeal, filed in the Opposition against EP1645631, dated Sep. 28, 2012, 2 pages.
Swaminathan (1996). "Molecular cloning of the three base restriction endonuclease R.CviJl from eukaryotic *Chlorella* virus IL-3A," Nucleic Acids Research, 24(13): 2463-2469.
TIGR Microbal Database, filed in the Opposition against EP1645631, dated Jun. 20, 2012, 14 pages.
U.S. Appl. No. 60/647,911, "GNA 1870-based vesicle vaccines for broad spectrum protection against diseases caused by *Neisseria meningitidis*," filed Jan. 27, 2005.
Vesikari et al. (2013). "Immunogenicity and safety of an investigational multicomponent, recombinant, meningococcal serogroup B vaccine (4CMenB) administered concomitantly with routine infant and child vaccinations: results of two randomized trials," Lancet 381:625-35.
Voulhoux and Tommassen (2002). "Transport of lipoproteins to the cell surfac in *Neisseria meningitidis*," 13th International Pathogenic *Neisseria* Conference 2002.
Written Submission to Oral Proceedings, filed in opposition against EP1976990, dated May 8, 2013, 11 pages.
Zollinger et al. (2010). "Design and evaluation in mice of a broadly protective meningococcal group B native outer membrane vesicle vaccine," Vaccine, 28(31):5057-5067.

* cited by examiner

FIGURE 1

```
                    . . . .10. . . .20. . . .30. . . .40. . . .50
312294    1: MTRSKPVNRTAFCCLSLTAALILTACSSGGGGVAADICAGIADALIAP  : 50
96           :                                                 :
96217     1: MTRSKPVNRTAFCCLSLTAALILTACSSGGGGVAADICAGIADALIAP  : 50
M1090     1: MTRSKPVNRTAFCCLSLTAALILTACSSGGGGVAADICAGIADALIAP  : 50
95N477    1: MTRSKPVNRTAFCCLSLTAALILTACSSGGGGVAADICAGIADALIAP  : 50
C11       1: MTRSKPVNRTAFCCLSLTAALILTACSSGGGGVAADICAGIADALIAP  : 50
599       1: MTRSKPVNRTAFCCLSLTAALILTACSSGGGGVAADICAGIADALIAP  : 50
24        1: ~~~~~~~~~~~~~~~~~~~~~~~~~~~~~~~~~~~~~~~ADAIIAPI  : 11
1000      1: MTRSKPVNRTAFCCLSLTAALILTACSSGGGGVAADICAGIADALITP  : 50
M1096     1: MTRSKPVNRTAFCCLSLTAALILTACSSGGGGVAADICAGIADALITP  : 50
BZ232     1: MTRSKPVNRTAFCCLSLTAALILTACSSGGGGVAADICAGIADALIAP  : 50
NGH38     1: MTRSKPVNRTAFCCLSLTAALILTACSSGGGGVAADICAGIADALIAP  : 50
25        1: ~~~~~~~~~~~~~~~~~~~~~~~~~~~~~~~~VAADICAGIADALIAP : 18
6700      1: MTRSKPVNRTAFCCFSLTAALILTACSSGGGGVAADICAGIADALIAP  : 50
93114     1: MTRSKPVNRTAFCCFSLTAALILTACSSGGGGVAADICAGIADALIAP  : 50
21        1: ~~~~~VNRTAFCCLSLTALILTACSSGGGGVAADICAGIADALIAP    : 44
3999         :~~~~~~~~~~~~~~~~~~~~~~~~~~~~~~~~~~~~~~~~~~~~~~~ :
3000         :~~~~~~~~~~~~~~~~~~~~~~~~~~~~~~~~~~~~~~~~~~~~~~~ :
7            :~~~~~~~~~~~~~~~~~~~~~~~~~~~~~~~~~~~~~~~~~~~~~~~ :
7200         :~~~~~~~~~~~~~~~~~~~~~~~~~~~~~~~~~~~~~~~~~~~~~~~ :
M198172   1: MTRSKPVNRTAFCCLSLTAALILTACSSGGGGVAADICAGIADALIAP  : 50
BZ133     1: MTRSKPVNRTAFCCLSLTAALILTACSSGGGGVAADICAGIADALIAP  : 50
220173I   1: MTRSKPVNRTAFCCLSLTALILTACSSGGGGVAADICAGIADALIAP   : 50

. . . .60. . . .70. . . .80. . . .90. . . 100
312294   51: IKDKSLQSLTLDQSVRKNEKLKLAAQGAEKTYGNGDSLNTGKLKNDKVSR :100
96        1: ~KDKSLQSLTLDQSVRKNEKLKLAAQGAEKTYGNGDSLNTGKLKNDKVSR : 49
96217    51: IKDKSLQSLTLDQSVRKNEKLKLAAQGAEKTYGNGDSLNTGKLKNDKVSR :100
M1090    51: IKDKSLQSLTLDQSVRKNEKLKLAAQGAEKTYGNGDSLNTGKLKNDKVSR :100
95N477   51: IKDKSLQSLTLDQSVRKNEKLKLAAQGAEKTYGNGDSLNTGKLKNDKVSR :100
C11      51: IKDKSLQSLTLDQSVRKNEKLKLAAQGAEKTYGNGDSLNTGKLKNDKVSR :100
599      51: IKDKGLQSLTLDQSVRKNEKLKLAAQGAEKTYGNGDSLNTGKLKNDKVSR :100
24       12: IKDKSLQSLTLDQSVRKNEKLKLAAQGAEKTYGNGDSLNTGKLKNDKVSR : 61
1000     51: IKDKSLQSLTLDQSVRKNEKLKLAAQGAEKTYGNGDSLNTGKLKNDKVSR :100
M1096    51: IKDKSLQSLTLDQSVRKNEKLKLAAQGAEKTYGNGDSLNTGKLKNDKVSR :100
BZ232    51: IKDKSLQSLTLDQSVRKNEKLKLAAQGAEKTYGNGDSLNTGKLKNDKVSR :100
NGH38    51: IKDKSLQSLTLDQSVRKNEKLKLAAQGAEKTYGNGDSLNTGKLKNDKVSR :100
25       19: IKDKGLQSLMLDQSVRKNEKLKLAAQGAEKTYGNGDSLNTGKLKNDKVSR : 68
6700     51: IKDKSLQSLTLDQSVRKNEKLKLAAQGAEKTYGNGDSLNTGKLKNDKVSR :100
93114    51: IKDKSLQSLTLDQSVRKNEKLKLAAQGAEKTYGNGDSLNTGKLKNDKVSR :100
21       45: IDKGLQSLTLDQSVRKNEKLKLAAQGAEKTYGNGDSLNTGKLKNDKVSR  : 94
3999      1: ~~DKGLQSLTLDQSVRKNEKLKLAAQGAEKTYGNGDSLNTGKLKNDKVSR : 48
3000      1: ~~DKGLQSLTLDQSVRKNEKLKLAAQGAEKTYGNGDSLNTGKLKNDKVSR : 49
7         1: ~~~~~~LQSLTLDQSVRKNEKLKLAAQGAEKTYGNGDSLNTGKLKNDKVSR: 45
7200      1: ~~~~~~LQSLTLDQSVRKNEKLKLAAQGAEKTYGNGDSLNTGKLKNDKVSR: 45
M198172  51: IKDKSLQSLTLDQSVRKNEKLKLAAQGAEKTYGNGDSLNTGKLKNDKVSR :100
BZ133    51: IKDKSLQSLTLDQSVRKNEKLKLAAQGAEKTYGNGDSLNTGKLKNDKVSR :100
220173I  51: IKDKGLQSLTLDQSVRKNEKLKLAAQGAEKTYGNGDSLNTGKLKNDKVSR :100
```

FIGURE 1 CONTD...

```
              . . .110 . . .120 . . .130 . . .140 . . .150
312294   101:FDFIRQIEVDGQLITLESGEFQIYKQDHSAVVALQIEK NN DKIDSLIN:150
96        50:FDFIRQIEVDGQLITLESGEFQIYKQDHSAVVALQIEK NN DKIDSLIN: 99
96217    101:FDFIRQIEVDGQLITLESGEFQIYKQDHSAVVALQIEK NN DKIDSLIN:150
M1090    101:FDFIRQIEVDGQLITLESGEFQIYKQDHSAVVALQIEK NN DKIDSLIN:150
95N477   101:FDFIRQIEVDGQLITLESGEFQIYKQDHSAVVALQIEK NN DKIDSLIN:150
C11      101:FDFIRQIEVDGQLITLESGEFQIYKQDHSAVVALQIEK NN DKIDSLIN:150
599      101:FDFIRQIEVDGQLITLESGEFQIYKQDHSAVVALQIEK NN DKIDSLIN:150
24        62:FDFIRQIEVDGQLITLESGEFQIYKQDHSAVVALQIEK NN DKIDSLIN:111
1000     101:FDFIRQIEVDGQTITIASGEFQIYKQNHSAVVALQIEK NN DKIDSLIN:150
M1096    101:FDFIRQIEVDGQTITIASGEFQIYKQNHSAVVALQIEK NN DKIDSLIN:150
BZ232    101:FDFIRQIEVDGQTITLASGEFQIYKQNHSAVVALQIEK NN DKIDSLIN:150
NGH38    101:FDFIRQIEVDGQTITLASGEFQIYKQNHSAVVALQIEK NN DKIDSLIN:150
25        69:FDFIRQIEVDGQTITLASGEFQIYKQNHSAVVALQIEK NN DKIDSLIN:118
6700     101:FDFIRQIEVDGQLITLESGEFQVYKQSHSALTAIQTEQEQD EHSGKMVA:150
93114    101:FDFIRQIEVDGQLITLESGEFQMYKQSHSALTAIQTEQEQD EHSGKMVA:150
21        95:FDFIRQIEVDGQLITLESGEFQVYKQSHSALTAFQTEQ QDSEHSGKMVA:144
3999      49:FDFIRQIEVDGQLITLESGEFQVYKQSHSALTAFQTEQ QDSEHSGKMVA: 98
3000      50:FDFIRQIEVDGQLITLESGEFQVYKQSHSALTAFQTEQ QDSEHSGKMVA: 99
7         46:FDFIRQIEVDGQLITLESGEFQVYKQSHSALTAFQTEQ QDSEHSGKMVA: 95
7200      46:FDFIRQIEVDGQLITLESGEFQVYKQSHSALTAFQTEQ QDSEHSGKMVA: 95
M198172  101:FDFIRQIEVDGQLITLESGEFQVYKQSHSALTAIQTEQVQDSEHSGKMVA:150
BZ133    101:FDFIRQIEVDGQLITLESGEFQVYKQSHSALTAIQTEQVQDSEHSGKMVA:150
220173I  101:FDFIRQIEVDGQLITLESGEFQVYKQSHSALTAFQTEQ QDSEHSGKMVA:150

. . .160 . . .170 . . .180 . . .190 . . .200
312294   151:QRSFLVSGLGGEHTAFNQLFI.KAEYHGKAFSSDDGGKLTYIDFAAK:199
96       100:QRSFLVSGLGGEHTAFNQLFI.KAEYHGKAFSSDDGGKLTYIDFAAK:148
96217    151:QRSFLVSGLGGEHTAFNQLFI.KAEYHGKAFSSDDGGKLTYIDFAAK:199
M1090    151:QRSFLVSGLGGEHTAFNQLFS.KAEYHGKAFSSDDGGKLTYIDFAAK:199
95N477   151:QRSFLVSGLGGEHTAFNQLFS.KAEYHGKAFSSDDPNRIHYSIDFTK:199
C11      151:QRSFLVSGLGGEHTAFNQLFS.KAEYHGKAFSSDDPNRIHYSIDFTK:199
599      151:QRSFLVSGLGGEHTAFNQLFS.KAEYHGKAFSSDDPNRIHYSIDFTK:199
24       112:QRSFLVSGLGGEHTAFNQLFS.KAEYHGKAFSSDDPNRIHYSIDFTK:160
1000     151:QRSFLVSGLGGEHTAFNQLFI.KAEYHGKAFSSDDPNRIHYSIDFTK:199
M1096    151:QRSFLVSGLGGEHTAFNQLFI.KAEYHGKAFSSDDPNRIHYSIDFTK:199
BZ232    151:QRSFLVSGLGGEHTAFNQLFI.KAEYHGKAFSSDDPNRIHYSIDFTK:199
NGH38    151:QRSFLVSGLGGEHTAFNQLFI.KAEYHGKAFSSDDPNRIHYSIDFTK:199
25       119:QRSFLVSGLGGEHTAFNQLPI.KAEYHGKAFSSDDPNRIHYSIDFTK:167
6700     151:KRRFKIGDIAGEHTSFDKLFKDVMTYRGTAFGSDDGGKLTYIDFAAK:200
93114    151:KRRFKIGDIAGEHTSFDKLFKDVMTYRGTAFGSDDGGKLTYIDFAAK:200
21       145:KRQFRIGDIAGEHTSFDKLP.GRATYRGTAFGSDDGGKLTYIDFAAK:194
3999      99:KRQFRIGDIAGEHTSFDKLP.GRATYRGTAFGSDDGGKLTYIDFAAK:148
3000     100:KRQFRIGDIAGEHTSFDKLP.GRATYRGTAFGSDDGGKLTYIDFAAK:149
7         96:KRQFRIGDIAGEHTSFDKLP.GRATYRGTAFGSDDGGKLTYIDFAAK:145
7200      96:KRQFRIGDIAGEHTSFDKLP.GRATYRGTAFGSDDGGKLTYIDFAAK:145
M198172  151:KRQFRIGDIAGEHTSFDKLP.GRATYRGTAFGSDDSGKLTYIDFAAK:200
BZ133    151:KRQFRIGDIAGEHTSFDKLP.GRATYRGTAFGSDDSGKLTYIDFAAK:200
220173I  151:KRQFRIGDIAGEHTSFDKLP.GRATYRGTAFGSDDGGKLTYIDFAAK:200
```

FIGURE 1 CONTD...

```
            . . . 210 . . . 220 . . . 230 . . . 240 . . . 250
312294   200:QCHGKIEHLKTPEQNVLAAFELHADISHAVLLDTRFGSEEKGTYHLA:249
96       149:QCHGKIFHLKTPEQNVFLAAFELHADIKSHAVILLDTRFGSEEKGTYHLA:198
96217    200:QCHGKIEHLKTPEQNVFLAAFELHADIKSHAVLLDTRFGSELKGTYHLA:249
M1090    200:QCHGKIEHLKTPEQNVLLASFELKADIKSHAVILLDTRFGGELKGTYHLA:249
95N477   200:QCYGRIEHLKTPEQNVLLASFELHADIKSHAVILLDTRFGGEEKGTYHLA:249
C11      200:QCYGRIEHLKTPEQNVFLASFELHADIKSHAVILLDTRFGGEEKGTYHLA:249
599      200:QCYGRIEHLKTPEQNVFLASFELHADIKSHAVILLDTRFGGEEKGTYHLA:249
24       161:QCYGRIEHLKTPEQNVFLASFELKADIKSHAVILLDTRFGGEKGTYHLA:210
1000     200:QCYGRIEHLKTPEQNVFLASFELKADIKSHAVILLDTRFGGEEKGTYHLA:249
M1096    200:QCYGRIEHLKTPEQNVLLASFELKADIKSHAVILLDTRFGGEEKGTYHLA:249
BZ232    200:QCYGRIEHLKTPEQNVLLASFELHADIKSHAVILLDTRFGGEEKGTYHLA:249
NGH38    200:QCYGRIEHLKTPEQNVLLASFELKADIKSHAVILLDTRFGGEKGTYHLA:249
25       168:QCYGRIEHLKTPEQNVLLASFELHADIKSHAVLLDTRFGGEEKGTYHLA:217
6700     201:QCHGKIEHLKSPELAVFLATFYIKPDEHHAVISHSVLYNQDEKGSYSLG:250
93114    201:QCHGKIEHLKSPELAVFLATFYIIPDEHHAVISHSVLYNQDEKGSYSLG:250
21       195:QCNGKIEHLKSPELAVDLAADIKPCGKRHAVISHSVLYNQAEKGSYSLG:244
3999     149:QCNGKIEHLKSPELAVDLAADIKPCGKRHAVISHSVLYNQAEKGSYSLG:198
3000     150:QGNGKIEHLKSPELAVDLAADIKPGGKRHAVISHSVLYNQAEKGSYSLG:199
7        146:QGNGKIEHLKSPELAVDLAADIKPGGKRHAVISHSVLYNQAEKGSYSLG:195
7200     146:QGNGKIEHLKSPELAVDLAADIKPGGKRHAVISHSVLYNQAEKGSYSLG:195
M198172  201:QCHGKIEHLKSPELAVDLAASDIKPKKRHAVISHSVLYNQAEKGSYSLG:250
BZ133    201:QCHGKIEHLKSPELAVDLAASDIKPKKRHAVISHSVLYNQAEKGSYSLG:250
22017 3I 201:QCNGKIEHLKSPELAVDLAADIKPGGKRHAVISHSVLYNQAEKGSYSLG:250

. . . 260 . . . 270 . . . 280
312294   250:LFGDRAQIIAGSATIGEKVETIG:279
96       199:LFGDRAQIIAGSAT~~~~~~~~~~~~~~:212
96217    250:LFGDRAQIIAGSATIGEKVETIG:279
M1090    250:LFGDRAQIIAGSATIREKVETIG:279
95N477   250:LFGDRAQIIAGSATIREKVETIG:279
C11      250:LFGDRAQIIAGSATIREKVETIG:279
599      250:LFGDRAQIIAGSATIREKVETIG:279
24       211:LFGDRAQIIAGSATIREKVET~~~~~~~:234
1000     250:LFGDRAQIIAGSATIREKVETIG:279
M1096    250:LFGDRAQIIAGSATIREKVETIG:279
BZ232    250:LFGDRAQIIAGSATIREKVETIG:279
NGH38    250:LFGDRAQIIAGSATIREKVETIG:279
25       218:LFGDRAQIIAGSATIREKVETIG:247
6700     251:IFGGQAQIVAGSAEETANGIRHLLAA:280
93114    251:IFGGQAQIVAGSAEETANGIRHLLAA:280
21       245:IFGGKAQIVAGSAETVNGIRHLLAA:274
3999     199:IFGGKAQIVAGSAETVNGIRHLLAA:228
3000     200:IFGGKAQIVAGSAETVNGIRHLLAA:229
7        196:IFGGKAQIVAGSAETVNGIRHLLAA:225
7200     196:IFGGKAQIVAGSAETVNGIRHLLAA:225
M198172  251:IFGGQAQIVAGSAEETANGIRHLLAA:280
BZ133    251:IFGGQAQIVAGSAEETANGIRHLLAA:280
22017 3I 251:IFGGKA~~~~~~~~~~~~~~~~~~~~~:256
```

FIGURE 2

```
            10        20        30        40        50        60        70
            |         |         |         |         |         |         |
TCCGCCGCATTACCTTATAAAATAAAACATCCCTCTCAAGCAGTCTGATAATGTTTGGATTGCTTGAGATTGATGAG
............................................................................
TCCGCCGCATTACCTTATAAAATAAAACATCCCTCTCAAGCAGTCTGATAATGTTTGGATTGCTTGAGATTGATGAG 80        90       100       110       120       130       140       150
    |         |         |         |         |         |         |         |
TGATGGTGTTAAATTCAAACTTTAAATTAATAACTTATGGGAAATTTCTTATTTATATAGAGGCATTAGTTGCCAAC
.  ......................................................  ..................
TAATGGTGTTAAATTCAACCTTTAAATTAATAACTTATGGGAAATTTCTTA----TATAGAGGCATTAGTTGCCAAC 160       170       180       190       200       210       220       230
       |         |         |         |         |         |         |         |
AAGATGAGCAAAATAATGGACAGTTAAAACCTAAAGGTAATAAAGCTGAAGTTGCAATTCGTTATGATGGTAAGTTT
................................................................................
AAGATGAGCAAAATAATGGACAGTTAAAACCTAAAGGTAATAAAGCTGAAGTTGCAATTCGTTATGATGGTAAGTTT 240       250       260       270       280       290       300
       |         |         |         |         |         |         |
AAATATGATGGTAAAGCTACACATGGTCCAAGTGTGAAGAATGCAGTTTACGCCCATCAAATTGAAACAGATCTATA
..........................................................................  ......
AAATATGATGGTAAAGCTACACATGGTCCAAGTGTGAAGAATGCAGTTTACGCCCATCAAATTGAAACAGGTCTATA 310       320       330       340       350       360       370       380
    |         |         |         |         |         |         |         |
TGACGGATGTTATATATCTACGACAACAGACAAGGAAATTGCCAAGAAATTTGCAACAAGCTCCGGCATCGAAAATG
.......................................................      ................
TGACGGATGTTATATATCTACGACAACAGACAAGGAAATTGCCAAGAAATTTGCAACAAGTTCCGGCATCGAAAATG 390       400       410       420       430       440       450       460
       |         |         |         |         |         |         |         |
GCTATATATATGTTTTAAATAGAGATTTGTTTGGTCAATATTCTATTTTTGAATATGAGGTTGAACATCCAGAAAAC
...........................  ................................................
GCTATATATATGTTTTAAATAGGGATTTGTTTGGTCAATATTCTATTTTTGAATATGAGGTTGAACATCCAGAAAAC 470       480       490       500       510       520       530
       |         |         |         |         |         |         |
CCAGATGAGAAGGAAGTAACAATCAGAGCTGAAGATTGTGGCTGTATTCCTGAAGAAGTGATTATTGCTAAAGAGTT
...  ..........................................................................
CCAAATGAGAAGGAAGTAACAATCAGAGCTGAAGATTGTGGCTGTATTCCTGAAGAAGTGATTATTGCTAAAGAGTT 540       550       560       570       580       590       600       610
 |         |         |         |         |         |         |         |
GATAGAAATTAACTAAGTTGAAAGGTCAATATAATGGCTTTAGTTGAATTGAAAGTGCCCGACATTGGCGGACACGA
.............................................................................
GATAGAAATTAACTAAGTTGAAAGGTCAATATAATGGCTTTAGTTGAATTGAAAGTGCCCGACATTGGCGGACACGA 620       630
    |         |
AAATGTAGATATTATCGC
..................
AAATGTAGATATTATCGC
```

FIGURE 3

ΔG287-919-His
ΔG287-Orf46.1-His
ΔG287-953-His
ΔG287-961-His
ΔG287-230-His
ΔG287-936-His
ΔG287-287-His
ΔG287-287$_{nz}$-His
ΔG287-287$_{nz}$-741$_{MC58}$-His
ΔG287-287$_{nz}$-741$_{ET37}$-His

ΔG287$_{nz}$-919-His
ΔG287$_{nz}$-953-His
ΔG287$_{nz}$-961-His
ΔG287$_{nz}$-287-His
ΔG287$_{nz}$-287$_{nz}$-His
ΔG287$_{nz}$-741$_{MC58}$-His

ΔG287-919-Orf46.1-His
ΔG287-Orf46.1-919-His
919-287-Orf46-His
Orf46.1-287-919-His 961c-741$_{MC58}$-His
961c-983-His
961c-Orf46.1-His
961cL-741$_{MC58}$
961cL-287
961c-230-His
961c-936-His

ΔG741$_{MC58}$-961c-His
ΔG741$_{MC58}$-961-His
ΔG741$_{MC58}$-983-His
ΔG741$_{MC58}$-Orf46.1-His
ΔG741$_{MC58}$-741$_{MC58}$-His
ΔG741$_{MC58}$-741$_{ET37}$-His 919-287
953-287
919-Orf46.1-His

Orf46.1-287-His
Orf46.1-919-His
Orf46.1-741$_{MC58}$-His
Orf46.1-961-His
Orf46.1-961c-His
Orf46.1-983-His
Orf46.1-936-His
Orf46.1-230-His 230-741$_{MC58}$-His
230-Orf46.1-His
230-961-His
230-961c-His
936-741$_{MC58}$-His
936-Orf46.1-His
936-961-His
936-741$_{ET37}$-His

ΔG983-741$_{MC58}$-His
ΔG983-961c-His
ΔG983-961-His
ΔG983-Orf46.1-His

HYBRID AND TANDEM EXPRESSION OF NEISSERIAL PROTEINS

This application is a National Stage application of PCT application PCT/IB02/03904 filed Sep. 6, 2002, which was published in English under PCT Article 21(2) on Mar. 13, 3002, which claims the benefit of Great Britain application Serial No. GB0121591.2 filed Sep. 6, 2001. These applications are incorporated herein by reference in their entireties.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 223002100600SubSequenceListing2.txt, date recorded: Aug. 8, 2013, size: 5 MB).

TECHNICAL FIELD

This invention is in the field of protein expression. In particular, it relates to the expression of proteins from Neisseria (e.g. N. gonorrhoeae or, preferably, N. meningitidis).

BACKGROUND ART

References 1 and 2 disclose alternative and improved approaches for the expression of the Neisserial proteins disclosed in references 3 to 6. One such method is to produce 'hybrid' proteins in which two or more Neisserial proteins are expressed as a single polypeptide chain. This approach offers two advantages. First, a protein that may be unstable or poorly expressed on its own can be assisted by adding a suitable hybrid partner that overcomes the problem. Second, commercial manufacture is simplified as only one expression and purification need be employed in order to produce two separately-useful proteins.

It is an object of the present invention to provide further alternative and improved approaches for the expression of Neisserial proteins.

DISCLOSURE OF THE INVENTION

Hybrid Proteins

Thus the invention provides a method for the simultaneous expression of two or more (e.g. 3, 4, 5, 6 or more) Neisserial proteins, in which said two or more proteins are joined such that they are translated as a single polypeptide chain. In general, the hybrid proteins of the invention can be represented by the formula:

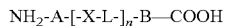

$NH_2$-A-[-X-L-]$_n$-B—COOH wherein X is an amino acid sequence, L is an optional linker amino acid sequence, A is an optional N-terminal amino acid sequence, B is an optional C-terminal amino acid sequence, and n is an integer greater than 1.

The value of n is between 2 and x, and the value of x is typically 3, 4, 5, 6, 7, 8, 9 or 10. Preferably n is 2, 3 or 4; it is more preferably 2 or 3; most preferably, n=2.

The -X- Moieties

There are two main groups of hybrid proteins according to the invention. These two groups are not mutually exclusive.

In the first group, each -X- moiety is:

(a) an orf1, orf4, orf25, orf40, orf46.1, orf83, NMB1343, 230, 233, 287, 292, 594, 687, 736, 741, 907, 919, 936, 953, 961 or 983 amino acid sequence;

(b) an amino acid sequence having sequence identity to an amino acid sequence from (a); or (c) an amino acid sequence comprising a fragment of an amino acid sequence from (a).

A preferred subset of (a) is: orf46.1, 230, 287, 741, 919, 936, 953, 961 and 983. A more preferred subset of (a) is: orf46.1, 287, 741 and 961. FIG. 3 shows preferred hybrid proteins.

In the second group, the hybrid protein comprises a first -X- moiety (-$X_a$-) and a second -X- moiety (-$X_b$-). The -$X_a$- moiety has one of the following amino acid sequences:

(d) the 446 even SEQ IDs (i.e. 2, 4, 6, . . . , 890, 892) disclosed in reference 3.

(e) the 45 even SEQ IDs (i.e. 2, 4, 6, . . . , 88, 90) disclosed in reference 4;

(f) the 1674 even SEQ IDs 2-3020, even SEQ IDs 3040-3114, and all SEQ IDs 3115-3241, disclosed in reference 5;

(g) the 2160 amino acid sequences NMB0001 to NMB2160 from reference 7; or (h) an amino acid sequence disclosed in reference 1 or reference 2.

The -$X_b$- moiety is related to -$X_a$- such that: (i) -$X_b$- has sequence identity to -$X_a$-, and/or (j) -$X_b$- comprises a fragment of -$X_a$-.

Examples of this second type of hybrid protein include proteins in which two or more -X- moieties are identical, or in which they are variants of the same protein e.g. two polymorphic forms of the same protein may be expressed as -$X_a$-$X_b$-, and three polymorphic forms may be expressed as -$X_a$-$X_b$-$X_c$- etc.

The -$X_a$- and -$X_b$- moieties may be in either order from N-terminus to C-terminus.

The -$X_a$- moiety is preferably an orf1, orf4, orf25, orf40, orf46.1, orf83, NMB1343, 230, 233, 287, 292, 594, 687, 736, 741, 907, 919, 936, 953, 961 or 983 amino acid sequence. The -$X_a$- moiety is more preferably an orf46.1, 230, 287, 741, 919, 936, 953, 961 or 983 amino acid sequence. The -$X_a$- moiety is most preferably an orf46.1, 287, 741 or 961 amino acid sequence.

In proteins where each of the n -X- moieties shares sequence identity to each other -X- moiety, the protein is referred to as a 'tandem protein'. Tandem proteins in which n=2 are preferred.

The degree of 'sequence identity' referred to in (b) and (i) is preferably greater than 50% (eg. 60%, 70%, 80%, 90%, 95%, 99% or more, up to 100%). This includes mutants, homologs, orthologs, allelic variants etc. [e.g. see ref. 8]. Identity is preferably determined by the Smith-Waterman homology search algorithm as implemented in the MPSRCH program (Oxford Molecular), using an affine gap search with parameters gap open penalty=12 and gap extension penalty=1. Typically, 50% identity or more between two proteins is considered as an indication of functional equivalence.

The 'fragment' referred to in (c) and (j) should consist of least m consecutive amino acids from an amino acid sequence from (a), (d), (e), (f), (g) or (h) and, depending on the particular sequence, m is 7 or more (eg. 8, 10, 12, 14, 16, 18, 20, 25, 30, 35, 40, 50, 60, 70, 80, 90, 100, 150, 200 or more).

Preferably the fragment comprises an epitope from an amino acid sequence from (a), (d), (e), (f), (g) or (h). Preferred fragments are those disclosed in references 9 and 10.

Preferred (c) and (j) fragments are C- and/or N-terminal truncations (e.g. Δ1-287, Δ2-287 etc.).

Preferred (b), (c), (i) and (j) sequences omit poly-glycine sequences. This has been found to aid expression [ref. 2]. Poly-glycine sequences can be represented as (Gly)$_g$, where g≥3 (e.g. 4, 5, 6, 7, 8, 9 or more). If a -X- moiety includes a poly-glycine sequence in its wild-type form, it is preferred to omit this sequence in the hybrid proteins of the invention. This may be by disrupting or removing the $(Gly)_g$—by deletion (e.g. CGGGGS (SEQ ID NO: 2198)→CGGGS (SEQ ID NO: 2199), CGGS (SEQ ID NO: 2200), CGS or CS), by substitution (e.g. CGGGGS (SEQ ID NO: 2198)→CGXGGS (SEQ ID NO: 2201), CGXXGS (SEQ ID NO: 2202), CGXGXS (SEQ ID NO: 2203) etc.), and/or by insertion (e.g. CGGGGS (SEQ ID NO: 2198)→CGGXGGS (SEQ ID NO: 2204), CGXGGGS (SEQ ID NO: 2205), etc.). Deletion of $(Gly)_g$ is preferred, and deletion of the N-terminus portion of a protein up to and including the poly-glycine sequence (e.g. deletion of residues 1-32 in SEQ ID 1) is referred to herein as 'ΔG'. Poly-glycine omission is particularly useful for proteins 287, 741, 983 and Tbp2 (ΔG287, ΔG741, ΔG983 and ΔGTbp2—references 1 & 2).

Preferred (c) and (j) fragments omit complete protein domains. This is particularly useful for protein 961, 287, and ORF46. Once a protein has been notional divided into domains, (c) and (j) fragments can omit one or more of these domains (e.g. 287B, 287C, 287BC, $ORF46_{1-433}$, $ORF46_{434-608}$, 961c—reference 2; FIGS. 4 and 5 herein).

287 protein has been notionally split into three domains, referred to as A, B & C (see FIG. 5 of reference 2). Domain B aligns with IgA proteases, domain C aligns with transferrin-binding proteins, and domain A shows no strong alignment with database sequences. An alignment of polymorphic forms of 287 is disclosed in reference 8.

ORF46 has been notionally split into two domains—a first domain (amino acids 1-433; ORF46.1) which is well-conserved between species and serogroups, and a second domain (amino acids 434-608) which is not well-conserved. The second domain is preferably deleted, leaving ORF46.1. An alignment of polymorphic forms of ORF46 is disclosed in reference 8.

961 protein has been notionally split into several domains (FIG. 4).

If a -X- moiety has a leader peptide sequence in its wild-type form, this may be included or omitted in the hybrid proteins of the invention. Where the leader peptide is omitted, this is a preferred example of an amino acid sequence within (c) and (j). In one embodiment, the leader peptides will be deleted except for that of the -X- moiety located at the N-terminus of the hybrid protein i.e. the leader peptide of $X_1$ will be retained, but the leader peptides of $X_2 \ldots X_n$ will be omitted. This is equivalent to deleting all leader peptides and using the leader peptide of X, as moiety -A-.

When n=2, preferred pairs of -X- moieties are: ΔG287 and 230; ΔG287 and 936; ΔG287 and 741; 961c and 287; 961c and 230; 961c and 936; 961cL and 287; 961cL and 230; 961cL and 936; ORF46.1 and 936; ORF46.1 and 230; 230 and 961; 230 and 741; 936 and 961; 936 and 741. When n=2, preferred pairs of -X- moieties for tandem proteins are: ΔG741 and 741; ΔG287 and 287. More specifically, the following combinations of $X_1$ and $X_2$ are preferred when n=2:

| $X_1$ | $X_2$ | $X_1$ | $X_2$ |
|---|---|---|---|
| ΔG287 | 230 | 230 | ΔG287 |
| ΔG287 | 936 | 936 | ΔG287 |
| ΔG287 | 741 | 741 | ΔG287 |
| ΔG287 | 961 | 961 | ΔG287 |
| ΔG287 | ORF46.1 | ORF46.1 | ΔG287 |
| ΔG287 | 919 | 919 | ΔG287 |
| ΔG287 | 953 | 953 | ΔG287 |
| 961c | 287 | 287 | 961c |

-continued

| $X_1$ | $X_2$ | $X_1$ | $X_2$ |
|---|---|---|---|
| 961c | 230 | 230 | 961c |
| 961c | 936 | 936 | 961c |
| 961c | 741 | 741 | 961c |
| 961c | 983 | 983 | 961c |
| 961c | ΔG983 | ΔG983 | 961c |
| 961c | ORF46.1 | ORF46.1 | 961c |
| 961 | ORF46.1 | ORF46.1 | 961 |
| 961cL | 287 | 287 | 961cL |
| 961cL | 230 | 230 | 961cL |
| 961cL | 936 | 936 | 961cL |
| ORF46.1 | 936 | 936 | ORF46.1 |
| ORF46.1 | 230 | 230 | ORF46.1 |
| ORF46.1 | 741 | 741 | ORF46.1 |
| ORF46.1 | ΔG741 | ΔG741 | ORF46.1 |
| ORF46.1 | 983 | 983 | ORF46.1 |
| ORF46.1 | ΔG983 | ΔG983 | ORF46.1 |
| 230 | 961 | 961 | 230 |
| 230 | 741 | 741 | 230 |
| 230 | ΔG741 | ΔG741 | 230 |
| 936 | 961 | 961 | 936 |
| 936 | 741 | 741 | 936 |
| 936 | ΔG741 | ΔG741 | 936 |
| ΔG741 | 741 | ΔG287 | 287 |
| ORF46.1 | 983 | 983 | ORF46.1 |
| ΔG741 | ORF46.1 | ORF46.1 | ΔG741 |
| ΔG741 | 983 | 983 | ΔG741 |
| ΔG741 | 961 | 961 | ΔG741 |
| ΔG741 | 961c | 961c | ΔG741 |
| ΔG983 | ORF46.1 | ORF46.1 | ΔG983 |
| ΔG983 | 961 | 961 | ΔG983 |
| ΔG983 | 961c | 961c | ΔG983 |

Where 287 is used in full-length form, it is preferably at the C-terminal end of a hybrid protein; if it is to be used at the N-terminus, if is preferred to use a ΔG form of 287. Similarly, Where 741 is used in full-length form, it is preferably at the C-terminal end of a hybrid protein; if it is to be used at the N-terminus, if is preferred to use a ΔG form of 741.

The -L- Moieties

For each n instances of [-X-L-], linker amino acid sequence -L- may be present or absent. For instance, when n=2 the hybrid may be $NH_2-X_1-L_1-X_2-L_2-COOH$, $NH_2-X_1-X_2-COOH$, $NH_2-X_1-L_1-X_2-COOH$, $NH_2-X_1-X_2-L_2-COOH$, etc.

Linker amino acid sequence(s) -L- will typically be short (e.g. 20 or fewer amino acids i.e. 19, 18, 17, 16, 15, 14, 13, 12, 11, 10, 9, 8, 7, 6, 5, 4, 3, 2, 1). Examples include short peptide sequences which facilitate cloning, poly-glycine linkers (i.e. $Gly_n$ where n=2, 3, 4, 5, 6, 7, 8, 9, 10 or more), and histidine tags (i.e. $His_n$ where n=3, 4, 5, 6, 7, 8, 9, 10 or more). Other suitable linker amino acid sequences will be apparent to those skilled in the art. A useful linker is GSGGGG (SEQ ID 27), with the Gly-Ser dipeptide being formed from a BamHI restriction site, thus aiding cloning and manipulation, and the $Gly_4$ tetrapeptide being a typical poly-glycine linker.

If $X_{n+1}$ is a ΔG protein and $L_n$ is a glycine linker, this may be equivalent to $X_{n+1}$ not being a ΔG protein and $L_n$ being absent.

The -A- Moiety

-A- is an optional N-terminal amino acid sequence. This will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct protein trafficking, or short peptide sequences which facilitate cloning or purification (e.g. histidine tags i.e. $His_n$ where n=3, 4, 5, 6, 7, 8, 9, 10 or more). Other suitable N-terminal amino acid sequences will be apparent to those skilled in the art. If $X_1$ lacks its own N-terminus methionine, -A- may be a methionine residue.

The -B- Moiety

-B- is an optional C-terminal amino acid sequence. This will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include sequences to direct protein trafficking, short peptide sequences which facilitate cloning or purification (e.g. comprising histidine tags i.e. $His_n$ where n=3, 4, 5, 6, 7, 8, 9, 10 or more), or sequences which enhance protein stability. Other suitable C-terminal amino acid sequences will be apparent to those skilled in the art.

Polymorphic Forms of Proteins

The invention can use amino acid sequences from any strains of *N. meningitidis*. References to a particular protein (e.g. '287', or 'ORF46.1') therefore include that protein from any strain. Sequence variations between strains are included within (b), (c), (i) and (j).

Reference sequences from *N. meningitidis* serogroup B include:

| Protein | Reference | Protein | Reference |
|---|---|---|---|
| orf1 | Ref. 3, SEQ ID 650 | orf4 | Ref. 3, SEQ ID 218 |
| orf25 | Ref. 3, SEQ ID 684 | orf40 | Ref. 4, SEQ ID 4 |
| orf46 | Ref. 6, SEQ ID 1049 | orf83 | Ref. 3, SEQ ID 314 |
| NMB1343 | Ref. 7, NMB1343 | 230 | Ref. 5, SEQ ID 830 |
| 233 | Ref. 5, SEQ ID 860 | 287 | Ref. 5, SEQ ID 3104 |
| 292 | Ref. 5, SEQ ID 1220 | 594 | Ref. 5, SEQ ID 1862 |
| 687 | Ref. 5, SEQ ID 2282 | 736 | Ref. 5, SEQ ID 2506 |
| 741 | Ref. 5, SEQ ID 2536 | 907 | Ref. 5, SEQ ID 2732 |
| 919 | Ref. 5, SEQ ID 3070 | 936 | Ref. 5, SEQ ID 2884 |
| 953 | Ref. 5, SEQ ID 2918 | 961 | Ref. 5, SEQ ID 940 |
| 983 | Ref. 7, NMB1969 | | |

Reference 8 discloses polymorphic forms of proteins ORF4, ORF40, ORF46, 225, 235, 287, 519, 726, 919 and 953. Polymorphic forms of 961 are disclosed in references 11 & 12. Any of these polymorphic forms may be used in accordance with the present invention.

The sequence listing herein includes polymorphic forms of proteins 741 (SEQ IDs 1-22) and NMB1343 (SEQ IDs 23-24) which have been identified. The sequence listing herein includes the amino acid sequence set forth as SEQ ID NO: 2884 in WO99/57280, which corresponds to SEQ ID NO: 2206 of the present application. The sequence listing herein includes the amino acid sequence set forth as SEQ ID NO: 2536 in WO99/57280, which corresponds to SEQ ID NO: 2207 of the present application.

Serogroups and Strains

Preferred proteins of the invention comprise -X- moieties having an amino acid sequence found in *N. Meningitidis* serogroup B. Within a single protein of the invention, individual -X- moieties may be from one or more strains. Where n=2, for instance, $X_2$ may be from the same strain as $X_1$ or from a different strain. Where n=3, the strains might be (i) $X_1=X_2=X_3$ (ii) $X_1=X_2\neq X_3$ (iii) $X_1\neq X_2=X_3$ (iv) $X_1\neq X_2\neq X_3$ or (v) $X_1=X_3\neq X_2$, etc.

Within serogroup B, preferred -X- moieties are from strains 2996, MC58, 95N477, or 394/98. Strain 95N477 is sometimes referred to herein as 'ET37', this being its electrophoretic type. Strain 394/98 is sometimes referred to herein as 'nz', as it is a New Zealand strain.

Where a form of 287 is used, this is preferably from strain 2996 or from strain 394/98.

Where a form of 741 is used, this is preferably from serogroup B strains MC58, 2996, 394/98, or 95N477, or from serogroup C strain 90/18311.

Where form of 961 is used, this is preferably from strain 2996.

Stains are indicated as a subscript e.g. $741_{MC58}$ is protein 741 from strain MC58. Unless otherwise stated, proteins mentioned herein (e.g. with no subscript) are from *N. meningitidis* strain 2996, which can be taken as a 'reference' strain. It will be appreciated, however, that the invention is not in general limited by strain. As mentioned above, general references to a protein (e.g. '287', '919' etc.) may be taken to include that protein from any strain. This will typically have sequence identity to 2996 of 90% or more (eg. 91%, 92%, 93%, 94%, 95%, 96%, 97%, 98%, 99% or more).

Domain-Based Expression of Protein 961

References 1 and 2 disclose how a protein can be notionally divided into domains and how the protein can be manipulated based on these domains. The present invention extends the application of this approach to protein 961 (also known as 'NadA' [11,12]).

In *N. meningitidis* serogroup B strain 2996, NadA has 405 amino acids. This protein has notionally been divided into the following nine domains (FIG. 4):

| Domain name | Amino acids |
|---|---|
| 961-1 'L' | 1-23 |
| 961-2 | 24-87 |
| 961-3 | 88-143 |
| 961-4 | 144-180 |
| 961-5 | 181-268 |
| 961-6 | 269-286 |
| 961-7 | 287-330 |
| 961-8 | 331-350 |
| 961-9 | 351-405 |

This information can be used to locate the same domains in other forms of 961.

These domains have been deleted from 961 in strain 2996 in various ways (FIG. 5). Preferred fragments of 961 omit one or more of these nine domains e.g. the following:

- 961-2 to 961-5 ('961a')
- 961-6 to 961-9 ('961b')
- 961-1 to 961-8 ('961cL')
- 961-2 to 961-8 ('961c')
- 961-2 to 961-6 and amino acids 287-325 from domain 961-7 ('961d')
- 961-2 to 961-8 and amino acids 351-383 from domain 961-9 ('961Δ1')
- 961-1 to 961-8 and amino acids 351-383 from domain 961-9 ('961Δ1L')
- 961-1 to 961-7 and amino acids 331-343 from domain 961-8 ('961cL-Δaro')
- 961-1 to 961-6 and amino acids 287-315 from domain 961-7 ('961cL-Δcc')
- 961-1 to 961-5 ('961aL')
- 961-1 to 961-4 ('961aL-Δ1')
- 961-1 to 961-3 ('961aL-Δ2')
- 961-1 to 961-2 ('961aL-Δ3')

These thirteen fragments (and sub-fragments thereof missing 1, 2, 3, 4 or 5 amino acids at either or both ends) are preferred (c) and (j) fragments, but they may also be expressed in their own right i.e. not in the form of a hybrid protein of the invention. Thus the invention provides a protein comprising one of these fragments, providing that the protein is not full-length 961 and is not a protein specifically disclosed in reference 1 or 2. This protein may be a fusion protein (e.g. a GST-fusion or a His-tag fusion).

Sequences

The invention also provides a protein having an amino acid sequence from SEQ IDs 1 to 24. It also provides proteins and nucleic acid having sequence identity to these. As described above, the degree of 'sequence identity' is preferably greater than 50% (eg. 60%, 70%, 80%, 90%, 95%, 99% or more).

The invention also provides nucleic acid encoding such proteins.

Furthermore, the invention provides nucleic acid which can hybridise to this nucleic acid, preferably under "high stringency" conditions (eg. 65° C. in a 0.1×SSC, 0.5% SDS solution).

The invention also provides nucleic acid encoding proteins according to the invention.

It should also be appreciated that the invention provides nucleic acid comprising sequences complementary to those described above (eg. for antisense or probing purposes).

Nucleic acid according to the invention can, of course, be prepared in many ways (eg. by chemical synthesis, from genomic or cDNA libraries, from the organism itself etc.) and can take various forms (eg. single stranded, double stranded, vectors, probes etc.).

In addition, the term "nucleic acid" includes DNA and RNA, and also their analogues, such as those containing modified backbones, and also peptide nucleic acids (PNA) etc.

Mixtures

The invention also provides a composition comprising two or more (i.e. 2, 3, 4, 5, 6 or 7) of the following proteins:

(1) 287
(2) 741
(3) ORF46.1
(4) 961
(5) $NH_2$-A-[-X-L-]$_n$-B—COOH, wherein n=2, $X_1$=287, $X_2$=953
(6) $NH_2$-A-[-X-L-]$_n$-B—COOH, wherein n=2, $X_1$=287, $X_2$=919
(7) $NH_2$-A-[-X-L-]$_n$-B—COOH, wherein n=2, $X_1$=287, $X_2$=961

The mixture may include one or both of the following proteins, either in combination with two or more of (1) to (7), or in combination with only one of (1) to (7):

(8) $NH_2$-A-[-X-L-]$_n$-B—COOH, wherein n=2, $X_1$=287, $X_2$=741
(9) $NH_2$-A-[-X-L-]$_n$-B—COOH, wherein n=2, $X_1$=936, $X_2$=741

Where proteins 287 and 741 are included in the mixture (i.e. in protein 1, 2, 5, 6, 7 or 8), they may be in the 'ΔG' form. Where protein 961 is included, it is preferably in the form of '961c' in which the N-terminus leader and C-terminus membrane anchor are absent [e.g. see refs. 1, 2 & 11].

A preferred mixture comprises the following three proteins:

(1) 961c, preferably $961c_{2996}$ (e.g. SEQ ID 31 herein);
(2) $NH_2$-A-[-X-L-]$_n$-B—COOH, wherein n is 2, -$X_1$- is ΔG287 (preferably $ΔG287_{NZ}$), -$X_2$- is 953 (preferably $953_{2996}$) lacking its leader peptide, -$L_1$- is GSGGGG, and -A- comprises a N-terminus methionine (e.g. -A- is M or MA) (e.g. SEQ IDs 28 & 29 herein); and
(3) $NH_2$-A-[-X-L-]$_n$-B—COOH, wherein n=2, $X_1$=936 (preferably $936_{2996}$), $X_2$=ΔG741 (preferably $ΔG741_{MC58}$), $L_1$=GSGGGG (e.g. SEQ ID 30 herein).

The mixtures may also comprise *N. meningitidis* outer membrane vesicles.

Heterologous Host

Whilst expression of the proteins of the invention may take place in *Neisseria*, the present invention preferably utilises a heterologous host. The heterologous host may be prokaryotic (e.g. a bacterium) or eukaryotic. It is preferably *E. coli*, but other suitable hosts include *Bacillus subtilis, Vibrio cholerae, Salmonella typhi, Salmonenna typhimurium, Neisseria lactamica, Neisseria cinerea, Mycobacteria* (e.g. *M. tuberculosis*), yeast etc.

Vectors Etc.

The invention provides (a) nucleic acid encoding the proteins described above (b) vectors comprising these nucleic acid sequences (c) host cells containing said vectors (d) compositions comprising the proteins or nucleic acids of the invention, which may be suitable as immunogenic compositions (e.g. vaccines) or as diagnostic reagents (e) these compositions for use as medicaments (e.g. as vaccines) or as diagnostic reagents (f) the use of these compositions in the manufacture of (1) a medicament for treating or preventing infection due to Neisserial bacteria (2) a diagnostic reagent for detecting the presence of Neisserial bacteria or of antibodies raised against *Neisseria* bacteria, and/or (3) a reagent which can raise antibodies against *Neisseria* bacteria and (g) a method of treating a patient, comprising administering to the patient a therapeutically effective amount of these compositions.

Implementing the invention will typically involve the basic steps of: obtaining a first nucleic acid encoding a first protein; obtaining a second nucleic acid encoding a second protein; and ligating the first and second nucleic acids. The resulting nucleic acid may be inserted into an expression vector, or may already be part of an expression vector.

To improve solubility, purification of hybrid proteins may involve the refolding techniques disclosed herein.

Immunogenic Compositions and Medicaments

The compositions of the invention are preferably immunogenic composition, and are more preferably vaccine compositions. The pH of the composition is preferably between 6 and 7. The pH may be maintained by the use of a buffer. The composition may be sterile.

Vaccines according to the invention may either be prophylactic (ie. to prevent infection) or therapeutic (ie. to treat infection), but will typically be prophylactic.

The invention also provides a composition of the invention for use as a medicament. The medicament is preferably able to raise an immune response in a mammal (ie. it is an immunogenic composition) and is more preferably a vaccine.

The invention also provides the use of a composition of the invention in the manufacture of a medicament for raising an immune response in a mammal. The medicament is preferably a vaccine.

The invention also provides a method for raising an immune response in a mammal comprising the step of administering an effective amount of a composition of the invention. The immune response is preferably protective. The method may raise a booster response.

The mammal is preferably a human. Where the vaccine is for prophylactic use, the human is preferably a child (e.g. a toddler or infant); where the vaccine is for prophylactic use, the human is preferably an adult. A vaccine intended for children may also be administered to adults e.g. to assess safety, dosage, immunogenicity, etc.

These uses and methods are preferably for the prevention and/or treatment of a disease caused by a *Neisseria* (e.g. meningitis, septicaemia, *gonorrhoea* etc.). The prevention and/or treatment of bacterial meningitis is preferred.

Further Components of the Composition

The composition of the invention will typically, in addition to the components mentioned above, comprise one or more 'pharmaceutically acceptable carriers', which include any carrier that does not itself induce the production of antibodies harmful to the individual receiving the composition. Suitable carriers are typically large, slowly metabolised macromolecules such as proteins, polysaccharides, polylactic acids, polyglycolic acids, polymeric amino acids, amino acid copolymers, trehalose (WO00/56365) and lipid aggregates (such as oil droplets or liposomes). Such carriers are well known to those of ordinary skill in the art. The vaccines may also contain diluents, such as water, saline, glycerol, etc. Additionally, auxiliary substances, such as wetting or emulsifying agents, pH buffering substances, and the like, may be present. A thorough discussion of pharmaceutically acceptable excipients is available in *Remington's Pharmaceutical Sciences*.

Immunogenic compositions used as vaccines comprise an immunologically effective amount of antigen, as well as any other of the above-mentioned components, as needed. By 'immunologically effective amount', it is meant that the administration of that amount to an individual, either in a single dose or as part of a series, is effective for treatment or prevention. This amount varies depending upon the health and physical condition of the individual to be treated, age, the taxonomic group of individual to be treated (e.g. non-human primate, primate, etc.), the capacity of the individual's immune system to synthesise antibodies, the degree of protection desired, the formulation of the vaccine, the treating doctor's assessment of the medical situation, and other relevant factors. It is expected that the amount will fall in a relatively broad range that can be determined through routine trials. Dosage treatment may be a single dose schedule or a multiple dose schedule (e.g. including booster doses). The vaccine may be administered in conjunction with other immunoregulatory agents.

The vaccine may be administered in conjunction with other immunoregulatory agents.

The composition may include other adjuvants in addition to (or in place of) the aluminium salt. Preferred adjuvants to enhance effectiveness of the composition include, but are not limited to: (1) oil-in-water emulsion formulations (with or without other specific immunostimulating agents such as muramyl peptides (see below) or bacterial cell wall components), such as for example (a) MF59™ (WO90/14837; Chapter 10 in ref. 13), containing 5% Squalene, 0.5% Tween 80, and 0.5% Span 85 (optionally containing MTP-PE) formulated into submicron particles using a microfluidizer, (b) SAF, containing 10% Squalane, 0.4% Tween 80, 5% pluronic-blocked polymer L121, and thr-MDP either microfluidized into a submicron emulsion or vortexed to generate a larger particle size emulsion, and (c) Ribi™ adjuvant system (RAS), (Ribi Immunochem, Hamilton, Mont.) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); (2) saponin adjuvants, such as QS21 or Stimulon™ (Cambridge Bioscience, Worcester, Mass.) may be used or particles generated therefrom such as ISCOMs (immunostimulating complexes), which ISCOMS may be devoid of additional detergent e.g. WO00/07621; (3) Complete Freund's Adjuvant (CFA) and Incomplete Freund's Adjuvant (IFA); (4) cytokines, such as interleukins (e.g. IL-1, IL-2, IL-4, IL-5, IL-6, IL-7, IL-12 (WO99/44636), etc.), interferons (e.g. gamma interferon), macrophage colony stimulating factor (M-CSF), tumor necrosis factor (TNF), etc.; (5) monophosphoryl lipid A (MPL) or 3-O-deacylated MPL (3dMPL) e.g. GB-2220221, EP-A-0689454; (6) combinations of 3dMPL with, for example, QS21 and/or oil-in-water emulsions e.g. EP-A-0835318, EP-A-0735898, EP-A-0761231; (7) oligonucleotides comprising CpG motifs [Krieg *Vaccine* 2000, 19, 618-622; Krieg *Curr opin Mol Ther* 2001 3:15-24; Roman et al., *Nat. Med.*, 1997, 3, 849-854; Weiner et al., *PNAS USA*, 1997, 94, 10833-10837; Davis et al., *J. Immunol.*, 1998, 160, 870-876; Chu et al., *J. Exp. Med.*, 1997, 186, 1623-1631; Lipford et al., *Eur. J. Immunol.*, 1997, 27, 2340-2344; Moldoveanu et al., *Vaccine*, 1988, 16, 1216-1224, Krieg et al., *Nature*, 1995, 374, 546-549; Klinman et al., *PNAS USA*, 1996, 93, 2879-2883; Ballas et al., *J. Immunol.*, 1996, 157, 1840-1845; Cowdery et al., *J. Immunol.*, 1996, 156, 4570-4575; Halpern et al., *Cell. Immunol.*, 1996, 167, 72-78; Yamamoto et al., *Jpn. J. Cancer Res.*, 1988, 79, 866-873; Stacey et al., *J. Immunol.*, 1996, 157, 2116-2122; Messina et al., *J. Immunol.*, 1991, 147, 1759-1764; Yi et al., *J. Immunol*, 1996, 157, 4918-4925; Yi et al., *J. Immunol.*, 1996, 157, 5394-5402; Yi et al., *J. Immunol.*, 1998, 160, 4755-4761; and Yi et al., *J. Immunol.*, 1998, 160, 5898-5906; International patent applications WO96/02555, WO98/16247, WO98/18810, WO98/40100, WO98/55495, WO98/37919 and WO98/52581] i.e. containing at least one CG dinucleotide, with 5-methylcytosine optionally being used in place of cytosine; (8) a polyoxyethylene ether or a polyoxyethylene ester e.g. WO99/52549; (9) a polyoxyethylene sorbitan ester surfactant in combination with an octoxynol (e.g. WO01/21207) or a polyoxyethylene alkyl ether or ester surfactant in combination with at least one additional non-ionic surfactant such as an octoxynol (e.g. WO01/21152); (10) an immunostimulatory oligonucleotide (e.g. a CpG oligonucleotide) and a saponin e.g. WO00/62800; (11) an immunostimulant and a particle of metal salt e.g. WO00/23105; (12) a saponin and an oil-in-water emulsion e.g. WO99/11241; (13) a saponin (e.g. QS21)+3dMPL+IL-12 (optionally+a sterol) e.g. WO98/57659; (14) other substances that act as immunostimulating agents to enhance the efficacy of the composition.

Muramyl peptides include N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-hydroxyphosphoryloxy)-ethylamine MTP-PE), etc.

Further Antigens

Further antigens which can be included in the composition of the invention include:

an outer-membrane vesicle (OMV) preparation from *N. meningitidis* serogroup B, such as those disclosed in refs. 14, 15, 16, 17 etc.

a saccharide antigen from *N. meningitidis* serogroup A, C, W135 and/or Y, such as the oligosaccharide disclosed in ref. 18 from serogroup C [see also ref. 19] or the oligosaccharides of ref. 20.

a saccharide antigen from *Streptococcus pneumoniae* [e.g. refs. 21, 22, 23].

a protein antigen from *Helicobacter pylori* such as CagA [e.g. 24], VacA [e.g. 24], NAP [e.g. 25], HopX [e.g. 26], HopY [e.g. 26] and/or urease.

an antigen from hepatitis A virus, such as inactivated virus [e.g. 27, 28].

an antigen from hepatitis B virus, such as the surface and/or core antigens [e.g. 28, 29].

an antigen from hepatitis C virus [e.g. 30].

an antigen from *Bordetella pertussis*, such as pertussis holotoxin (PT) and filamentous haemagglutinin (FHA) from *B. pertussis*, optionally also in combination with pertactin and/or agglutinogens 2 and 3 [e.g. refs. 31 & 32].

a diphtheria antigen, such as a diphtheria toxoid [e.g. chapter 3 of ref. 33] e.g. the $CRM_{197}$ mutant [e.g. 34].

a tetanus antigen, such as a tetanus toxoid [e.g. chapter 4 of ref. 33].

a saccharide antigen from *Haemophilus influenzae* B [e.g. 19].

an antigen from *N. gonorrhoeae* [e.g. 3, 4, 5].

an antigen from *Chlamydia pneumoniae* [e.g. 35, 36, 37, 38, 39, 40, 41].

an antigen from *Chlamydia trachomatis* [e.g. 42].

an antigen from *Porphyromonas gingivalis* [e.g. 43].

polio antigen(s) [e.g. 44, 45] such as IPV or OPV.

rabies antigen(s) [e.g. 46] such as lyophilised inactivated virus [e.g. 47, RabAvert™].

measles, mumps and/or rubella antigens [e.g. chapters 9, 10 & 11 of ref. 33].

influenza antigen(s) [e.g. chapter 19 of ref. 33], such as the haemagglutinin and/or neuraminidase surface proteins.

an antigen from *Moraxella catarrhalis* [e.g. 48].

a protein antigen from *Streptococcus agalactiae* (group B streptococcus) [e.g. 49, 50].

a saccharide antigen from *Streptococcus agalactiae* an antigen from *Streptococcus pyogenes* (group A streptococcus) [e.g. 50, 51, 52].

an antigen from *Staphylococcus aureus* [e.g. 53].

The composition may comprise one or more of these further antigens.

Where a saccharide or carbohydrate antigen is used, it is preferably conjugated to a carrier protein in order to enhance immunogenicity [e.g. refs. 54 to 63]. Preferred carrier proteins are bacterial toxins or toxoids, such as diphtheria or tetanus toxoids. The $CRM_{197}$ diphtheria toxoid is particularly preferred. Other suitable carrier proteins include the *N. meningitidis* outer membrane protein [e.g. ref. 64], synthetic peptides [e.g. 65, 66], heat shock proteins [e.g. 67], pertussis proteins [e.g. 68, 69], protein D from *H. influenzae* [e.g. 70], toxin A or B from *C. difficile* [e.g. 71], etc. Where a mixture comprises capsular saccharides from both serogroups A and C, it is preferred that the ratio (w/w) of MenA saccharide:MenC saccharide is greater than 1 (e.g. 2:1, 3:1, 4:1, 5:1, 10:1 or higher). Saccharides from different serogroups of *N. meningitidis* may be conjugated to the same or different carrier proteins.

Any suitable conjugation reaction can be used, with any suitable linker where necessary.

Toxic protein antigens may be detoxified where necessary (e.g. detoxification of *pertussis* toxin by chemical and/or genetic means [32]).

Where a diphtheria antigen is included in the composition it is preferred also to include tetanus antigen and *pertussis* antigens. Similarly, where a tetanus antigen is included it is preferred also to include diphtheria and *pertussis* antigens.

Similarly, where a *pertussis* antigen is included it is preferred also to include diphtheria and tetanus antigens.

Antigens are preferably mixed with (and more preferably adsorbed to) an aluminium salt (e.g. phosphate, hydroxide, hydroxyphosphate, oxyhydroxide, orthophosphate, sulphate). The salt may take any suitable form (e.g. gel, crystalline, amorphous etc.).

Antigens in the composition will typically be present at a concentration of at least 14 g/ml each. In general, the concentration of any given antigen will be sufficient to elicit an immune response against that antigen.

As an alternative to using proteins antigens in the composition of the invention, nucleic acid encoding the antigen may be used [e.g. refs. 72 to 80]. Protein components of the compositions of the invention may thus be replaced by nucleic acid (preferably DNA e.g. in the form of a plasmid) that encodes the protein.

Definitions

The term "comprising" means "including" as well as "consisting" e.g. a composition "comprising" X may consist exclusively of X or may include something additional e.g. X+Y.

The term "about" in relation to a numerical value x means, for example, x±10%.

BRIEF DESCRIPTION OF DRAWINGS

FIG. 1 shows an alignment of twenty-three sequences for protein 741. These are SEQ IDs 1 to 22 plus the sequence from MC58.

FIG. 2 shows an alignment of the NMB1343 sequence from gonococcus (top; SEQ ID 25) and meningococcus (bottom; SEQ ID 26).

FIG. 3 shows hybrid and tandem proteins of the invention.

MODES FOR CARRYING OUT THE INVENTION

Hybrid Proteins—$X_1$=ΔG287

Figure 4:
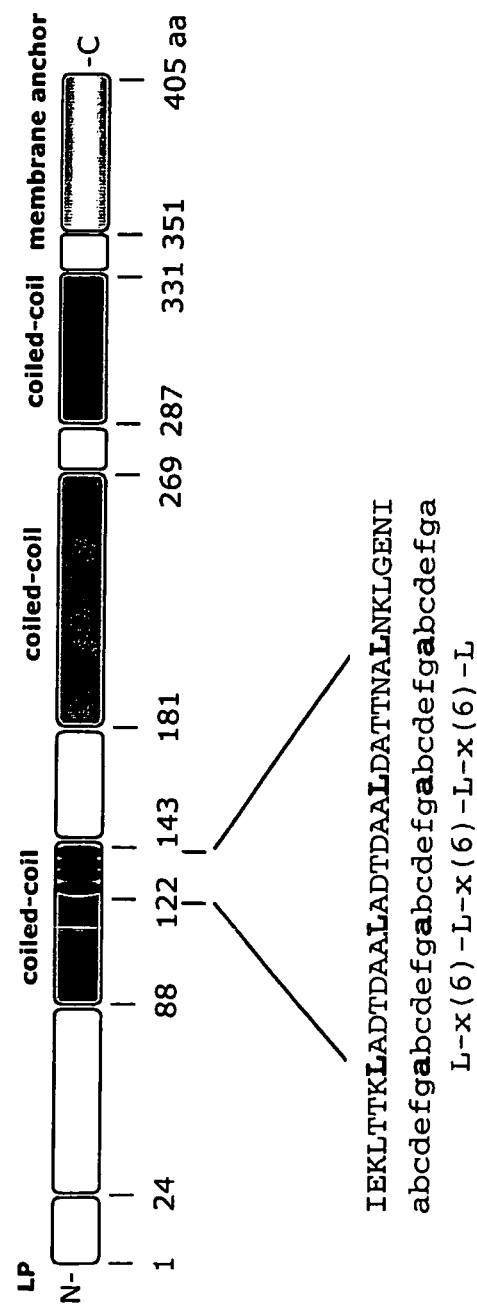
FIG. 4 shows 9 domains within $961_{2996}$.

In addition to those disclosed in references 1 & 2, seven hybrid proteins with ΔG287 from strain 2996 at the N-terminus were constructed. Eight 287 tandem proteins were also made (see below).

| # | n | $X_1$ | $L_1$ | $X_2$ | $L_2$ |
|---|---|---|---|---|---|
| 1 | 2 | ΔG287 | — | 230 | $(His)_6$ |
| 2 | 2 | | — | 936 | $(His)_6$ |
| 3 | 2 | | — | $741_{MC58}$ | $(His)_6$ |
| 4 | 2 | | — | $741_{ET37}$ | $(His)_6$ |
| 5 | 2 | | — | $741_{90/18311}$ | $(His)_6$ |
| 6 | 2 | | — | $741_{95N477}$ | $(His)_6$ |
| 7 | 2 | $ΔG287_{nz}$ | — | $741_{MC58}$ | $(His)_6$ |

These proteins were adjuvanted with either Freund's complete adjuvant (FCA) or 3 mg/ml alum and used to immunise mice. The resulting sera were tested against various Neisserial strains using the bactericidal assay. Titres using protein #3 were as follows:

| | Strain(serogroup) | | | | | |
|---|---|---|---|---|---|---|
| | 2996(B) | MC58(B) | NGH38(B) | 394/98(B) | 44/76(B) | F6124(A) |
| Al hydroxide | 8192 | 32768 | 8192 | >2048 | 16384 | 8192 |
| FCA | 16384 | 262144 | 8192 | >2048 | >32768 | 8192 |

In further experiments using protein #3 adjuvanted with aluminium hydroxide, anti-287 and anti-741 ELISA titres each exceeded 984150 and BCA titres were as follows:

| 2996(B) | MC58(B) | NGH38(B) | 394/98(B) | 44/76(B) | F6124(A) | BZ133(C) |
|---|---|---|---|---|---|---|
| 8000 | 65000 | 4000 | 4000 | 32000 | 8000 | 16000 |

Results obtained after immunisation with proteins disclosed in refs. 1 & 2, tested against the homologous strain, were as follows:

| n | $X_1$ | $L_1$ | $X_2$ | $L_2$ | Bactericidal titre | | ELISA | |
|---|---|---|---|---|---|---|---|---|
| | | | | | FCA | Alum | FCA | Alum |
| 2 | $\Delta G287_{394/98}$ | — | 961 | (His)$_6$ | — | 32768 | — | >109350 |
| | | | 919 | | 32768 | 4096 | 4718 | 3678 |
| | | | 953 | | >32768 | >16384 | 1900 | 6936 |
| | | | 741 | | 16384 | 2048 | 232 | 862 |
| 2 | $\Delta G287_{2996}$ | — | 961 | (His)$_6$ | 65536 | 32768 | 108627 | >109350 |
| | | | 919 | | 128000 | 32000 | 11851 | 2581 |
| | | | 953 | | 65536 | — | 3834 | — |
| | | | 741 | | 16384 | 8192 | 315 | 4645 |

Hybrid Proteins—$X_1$=961c or 961cL

In addition to those disclosed in references 1 & 2, eight hybrid proteins with either 961c or 961cL (i.e. 961c+leader peptide) at the N-terminus were constructed:

| # | n | $X_1$ | $L_1$ | $X_2$ | $L_2$ |
|---|---|---|---|---|---|
| 1 | 2 | 961c | — | 287 | — |
| 2 | 2 | | — | 287 | (His)$_6$ |
| 3 | 2 | | — | 230 | (His)$_6$ |
| 4 | 2 | | — | 936 | (His)$_6$ |
| 5 | 2 | 961cL | — | 287 | — |
| 6 | 2 | | — | 287 | (His)$_6$ |
| 7 | 2 | | — | 230 | (His)$_6$ |
| 8 | 2 | | — | 936 | (His)$_6$ |

These proteins were adjuvated with either Freund's complete adjuvant (FCA) or 3.3 mg/ml alum and used to immunise mice. The resulting sera were tested against various Neisserial strains using the bactericidal assay. Titres using protein #8 were as follows:

| | Strain(serogroup) | | | | |
|---|---|---|---|---|---|
| | 2996(B) | MC58(B) | 394/98(B) | 44/76(B) | F6124(A) |
| Al hydroxide | 8192 | 8192 | 512 | 1024 | <16 |
| FCA | 65536 | 16384 | >2048 | >2048 | 8192 |

Titres obtained after immunisation with 961c-741 [refs. 1 & 2] were as follows:

| | Strain(serogroup) | | | | | |
|---|---|---|---|---|---|---|
| | 2996(B) | MC58(B) | 394/98(B) | 44/76(B) | F6124(A) | BZ133(C) |
| Al hydroxide | 65536 | 32768 | 4096 | >32768 | 16384 | >2048 |
| FCA | >16384 | 262144 | 4096 | >16384 | — | >2048 |

These results could be improved by mixing 961c-741 with ORF46.1 or with $\Delta G287$-919.

Results obtained after immunisation with proteins disclosed in refs. 1 & 2, tested against the homologous strain, were as follows:

| n | $X_1$ | $L_1$ | $X_2$ | $L_2$ | Bactericidal titre | | ELISA | |
|---|---|---|---|---|---|---|---|---|
| | | | | | FCA | Alum | FCA | Alum |
| 2 | 961c | — | ORF46.1 | $(His)_6$ | 32768 | 1024 | >109350 | >109350 |
| | | | 741 | | >16384 | 8192 | >109350 | >109350 |
| | | | 936 | | >32768 | 8192 | >109350 | >109350 |

Hybrid Proteins—$X_1$=ORF46.1

In addition to those disclosed in references 1 & 2, two hybrid proteins with ORF46.1 at the N-terminus were constructed:

| # | n | $X_1$ | $L_1$ | $X_2$ | $L_2$ |
|---|---|---|---|---|---|
| 1 | 2 | ORF46.1 | — | 936 | $(His)_6$ |
| 2 | 2 | | — | 230 | $(His)_6$ |

These proteins were adjuvanted with either Freund's complete adjuvant (FCA) or 3 mg/ml alum and used to immunise mice. The resulting sera were tested against the homologous strain using the bactericidal assay and by ELISA.

Results obtained after immunisation with proteins disclosed in refs. 1 & 2 were as follows:

| n | $X_1$ | $L_1$ | $X_2$ | $L_2$ | Bactericidal titre | | ELISA | |
|---|---|---|---|---|---|---|---|---|
| | | | | | FCA | Alum | FCA | Alum |
| 2 | ORF46.1 | — | 961 | $(His)_6$ | 8192 | 8192 | 21558 | >109350 |
| | | — | $961_c$ | $(His)_6$ | 8192 | 128 | 9020 | 76545 |

Hybrid Proteins—$X_1$=230

In addition to those disclosed in references 1 & 2, four hybrid proteins with 230 at the N-terminus were constructed:

| # | n | $X_1$ | $L_1$ | $X_2$ | $L_2$ |
|---|---|---|---|---|---|
| 1 | 2 | 230 | — | ORF46.1 | $(His)_6$ |
| 2 | 2 | | — | 961 | $(His)_6$ |
| 3 | 2 | | — | 961c | $(His)_6$ |
| 4 | 2 | | — | $741_{MC58}$ | $(His)_6$ |

Hybrid Proteins—$X_1$=936

In addition to those disclosed in references 1 & 2, seven hybrid proteins with 936 at the N-terminus were constructed:

| # | n | $X_1$ | $L_1$ | $X_2$ | $L_2$ |
|---|---|---|---|---|---|
| 1 | 2 | 936 | — | ORF46.1 | $(His)_6$ |
| 2 | 2 | | — | 961 | $(His)_6$ |
| 3 | 2 | | — | $741_{ET37}$ | $(His)_6$ |
| 4 | 2 | | — | $741_{MC58}$ | $(His)_6$ |
| 5 | 2 | | — | $741_{90/18311}$ | $(His)_6$ |
| 6 | 2 | | — | $741_{95N477}$ | $(His)_6$ |
| 7 | 2 | | — | 741 | $(His)_6$ |

These proteins were adjuvanted with either Freund's complete adjuvant (FCA) or 3 mg/ml alum and used to immunise mice. The resulting sera were tested against various Neisserial strains using the bactericidal assay. Titres using protein #2 were as follows:

| | Strain$^{(serogroup)}$ | | | | |
|---|---|---|---|---|---|
| | $2996^{(B)}$ | $MC58^{(B)}$ | $394/98^{(B)}$ | $44/76^{(B)}$ | $F6124^{(A)}$ |
| Al hydroxide | 16384 | 32768 | 1024 | 2048 | <16 |
| FCA | 65536 | 65536 | >2048 | 8192 | $2048_{(36\%)}$ |

Titres using protein #4 were as follows:

| | Strain$^{(serogroup)}$ | | | | |
|---|---|---|---|---|---|
| | $2996^{(B)}$ | $MC58^{(B)}$ | $394/98^{(B)}$ | $44/76^{(B)}$ | $F6124^{(A)}$ |
| Al hydroxide | 256 | >262144 | >2048 | 32768 | 8192 |
| FCA | 1024 | >262144 | >2048 | >32768 | >32768 |

Titres using protein #7 were as follows:

| | Strain$^{(serogroup)}$ | | | | | |
|---|---|---|---|---|---|---|
| | $2996^{(B)}$ | $MC58^{(B)}$ | $394/98^{(B)}$ | $44/76^{(B)}$ | $F6124^{(A)}$ | $BZ133^{(C)}$ |
| Al hydroxide | 256 | 130000 | 16000 | 32000 | 8000 | 16000 |

Results obtained after immunisation with proteins disclosed in refs. 1 & 2, tested against the homologous strain, were as follows:

| n | $X_1$ | $L_1$ | $X_2$ | $L_2$ | Bactericidal titre | | ELISA | |
|---|---|---|---|---|---|---|---|---|
| | | | | | FCA | Alum | FCA | Alum |
| 2 | 936 | — | 741 | (His)$_6$ | 1024 | 256 | 1466 | 5715 |
| | | | 936 | | >32768 | >32768 | >109350 | >109350 |

Mixtures of Hybrid Proteins

Mice were immunised with of three proteins adjuvanted with aluminium hydroxide, either single or in a triple combination: (1) 287$_{NZ}$-953; (2) 936-741; and (3) 961c. The mixture was able to induce high bactericidal titres against various strains:

| | 2996$^{(B)}$ | MC58$^{(B)}$ | NGH38 | 394/98$^{(B)}$ | H44/76$^{(B)}$ | F6124$^{(A)}$ | BZ133$^{(C)}$ | C11$^{(C)}$ |
|---|---|---|---|---|---|---|---|---|
| (1) | 32000 | 16000 | 130000 | 16000 | 32000 | 8000 | 16000 | 8000 |
| (2) | 256 | 131000 | 128 | 16000 | 32000 | 8000 | 16000 | <4 |
| (3) | 32000 | 8000 | — | — | — | 8000 | — | 32000 |
| mix | 32000 | 32000 | 65000 | 16000 | 260000 | 65000 | >65000 | 8000 |
| (X) | 4000 | 4000 | 1000 | 1000 | >4000 | 1000 | 4000 | n.d. |

'—' indicates that this strain contains no NadA gene
(X) was a combination of protein 287 with outer membrane vesicles, for comparison Looking at individual mice, the mixture induced high and consistent bactericidal titres:

| | # | | | | | | | | | |
|---|---|---|---|---|---|---|---|---|---|---|
| | 1 | 2 | 3 | 4 | 5 | 6 | 7 | 8 | 9 | 10 |
| 2996 | 32768 | 16384 | 65536 | 32768 | 32768 | 65536 | 65536 | 32768 | 65536 | 8192 |
| MC58 | 65536 | 32768 | 65536 | 65536 | 65536 | 8192 | 65536 | 32768 | 32768 | 65536 |
| 394/98 | 65536 | 4096 | 16384 | 4096 | 8192 | 4096 | 32768 | 16384 | 8192 | 16384 |

Tandem Proteins

Hybrid proteins of the invention can be represented by formula $NH_2$—[—X-L-]$_n$-COOH. Where all n instances of -X- are the same basic protein (either identical, or the same protein from different strains or species), the protein is referred to as a 'tandem' protein.

Twelve specific tandem proteins are:

| # | n | $X_1$ | $L_1$ | $X_2$ | $L_2$ |
|---|---|---|---|---|---|
| 1 | 2 | ΔG741$_{MC58}$ | — | 741$_{MC58}$ | (His)$_6$ |
| 2 | 2 | ΔG287$_{2996}$ | (Gly)$_6$ | ΔG287$_{394/98}$ | (His)$_6$ |
| 3 | 2 | ΔG287$_{2996}$ | (Gly)$_6$ | ΔG287$_{2996}$ | (His)$_6$ |
| 4 | 2 | ΔG287$_{394/98}$ | (Gly)$_6$ | ΔG287$_{394/98}$ | (His)$_6$ |
| 5 | 2 | ΔG287$_{394/98}$ | (Gly)$_6$ | ΔG287$_{2996}$ | (His)$_6$ |
| 6 | 2 | ΔG287$_{2996}$ | (Gly)$_6$ | ΔG287$_{394/98}$ | — |
| 7 | 2 | ΔG287$_{2996}$ | (Gly)$_6$ | ΔG287$_{2996}$ | — |
| 8 | 2 | ΔG287$_{394/98}$ | (Gly)$_6$ | ΔG287$_{394/98}$ | — |
| 9 | 2 | ΔG287$_{394/98}$ | (Gly)$_6$ | ΔG287$_{2996}$ | — |
| 10 | 2 | ΔG741$_{MC58}$ | — | 741$_{394/98}$ | (His)$_6$ |
| 11 | 2 | ΔG741$_{MC58}$ | — | 741$_{90/18311}$ | (His)$_6$ |
| 12 | 2 | ΔG741$_{MC58}$ | — | 741$_{95N477}$ | (His)$_6$ |

Proteins #1 to #5 have all been expressed in soluble form in *E. coli*. Expression levels were between 0.24 and 0.50 mg protein per liter of culture. The tandem proteins were purified and mixed with aluminium phosphate as an adjuvant. Tandem proteins #2, #4 and #5 adsorbed readily to aluminium phosphate; adsorption was less complete for tandem proteins #1 and #3.

Allelic Variants—741

Twenty-two polymorphic sequences of 741 were found (SEQ IDs 1 to 22). SEQ ID NO: 1 provides the 741 sequence of meningococcal strain 1000. SEQ ID NO: 2 provides the 741 sequence of meningococcal strain 2201731 (premature stop codon, though reliable sequence). SEQ ID NO: 3 provides the 741 sequence of meningococcal strain 90/18311 (incomplete). SEQ ID NO: 4 provides the 741 sequence of meningococcal strain L93/4286 (incomplete). SEQ ID NO: 5 provides the 741 sequence of meningococcal strain 2996. SEQ ID NO: 6 provides the 741 sequence of meningococcal strain 30/00. SEQ ID NO: 7 provides the 741 sequence of meningococcal strain 312294. SEQ ID NO: 8 provides the 741 sequence of meningococcal strain 39/99 (incomplete). SEQ ID NO: 9 provides the 741 sequence of meningococcal strain 5/99. SEQ ID NO: 10 provides the 741 sequence of meningococcal strain 67/00. SEQ ID NO: 11 provides the 741 sequence of meningococcal strain BZ169. SEQ ID NO: 12 provides the 741 sequence of meningococcal strain 72/00. SEQ ID NO: 13 provides the 741 sequence of meningococcal strain 93/114. SEQ ID NO: 14 provides the 741 sequence of meningococcal strain 95N477. SEQ ID NO: 15 provides the 741 sequence of meningococcal strain 96217. SEQ ID NO: 16 provides the 741 sequence of meningococcal strain BZ133. SEQ ID NO: 17 provides the 741 sequence of meningococcal strain BZ232. SEQ ID NO: 18 provides the 741 sequence of meningococcal strain Cll. SEQ ID NO: 19 provides the 741 sequence of meningococcal strain MI090. SEQ ID NO: 20 provides the 741 sequence of meningococcal strain MI096. SEQ ID NO: 21 provides the 741 sequence of meningococcal strain M198/172. SEQ ID NO: 22 provides the 741 sequence of meningococcal strain NGH38. These and the MC58 sequence are aligned in FIG. 1.

Allelic Variants—NMB1343

Using PCR on 42 strains of meningococcus of various serogroups, the gene encoding NMB1343 protein was found in 24/42 and was absent in 18/42 strains (Table 1). The NMB1343 gene was sequenced for 10 of the NMB1343+ strains (Table 1, column 3). The nucleic acid sequence (and thus amino acid sequence SEQ ID 23; GenBank AAF41718) was identical in all 10 strains.

NMB1343 was also detected in two strains of *N. gonorrhoeae* (F62 and SN4). The amino acid sequence from gonococcus is SEQ ID 24. An alignment with the meningococcal sequence is:

```
              ....10....20....30....40....50
Ng    1:INNLWEISYLYRGISCQQDEQNNGQLKPKGNKAEVAIRYDGKFKYDGKAT: 50
Nm    1:-----MGNFLYRGISCQQDEQNNGQLKPKGNKAEVAIRYDGKFKYDGKAT: 45
              ....60....70....80....90...100
Ng   51:HGPSVKNAVYAHQIETDLYDGCYISTTTDKEIAKKFATSSGIENGYIYVL:100
Nm   46:HGPSVKNAVYAHQIETGLYDGCYISTTTDKEIAKKFATSSGIENGYIYVL: 95
              ...110...120...130...140...150
Ng  101:NRDLFGQYSIFEYEVEHPENPDEKEVTIRAEDCGCIPEEVIIAKELIEIN:150
Nm   96:NRDLFGQYSIFEYEVEHPENPNEKEVTIRAEDCGCIPEEVIIAKELIEIN:145
```

An alignment of the corresponding nucleotide sequences is shown in FIG. 2. This shows that the gonococcal sequence has a 4mer insertion in the 5' region of the NMB1343 gene which causes a frameshift and consequent loss of the 5' methionine residue.

Domain Deletion—961

961 is not present in the *N. meningitidis* serogroup A genome sequence [81], even though the surrounding regions are conserved (>90%) between serogroups A and B. References 11 and 12 disclose polymorphic forms of 961. The gene was found to be present in 91% of serogroup B strains belonging to hypervirulent lineages ET-5, ET-37 and cluster A4, but was absent in all strains of lineage 3 tested. Most of the serogroup C strains tested were positive even if not belonging to hypervirulent lineages. The same was true for the serogroup B strains with serotype 2a and 2b. For serogroup A, one strain belonging to subgroup M was positive whereas the other two strains belonging to subgroup IV-1 were negative. 961 was absent in *N. gonorrhoeae* and in commensal species *N. lactamica* and *N. cinerea*.

Figure 5:
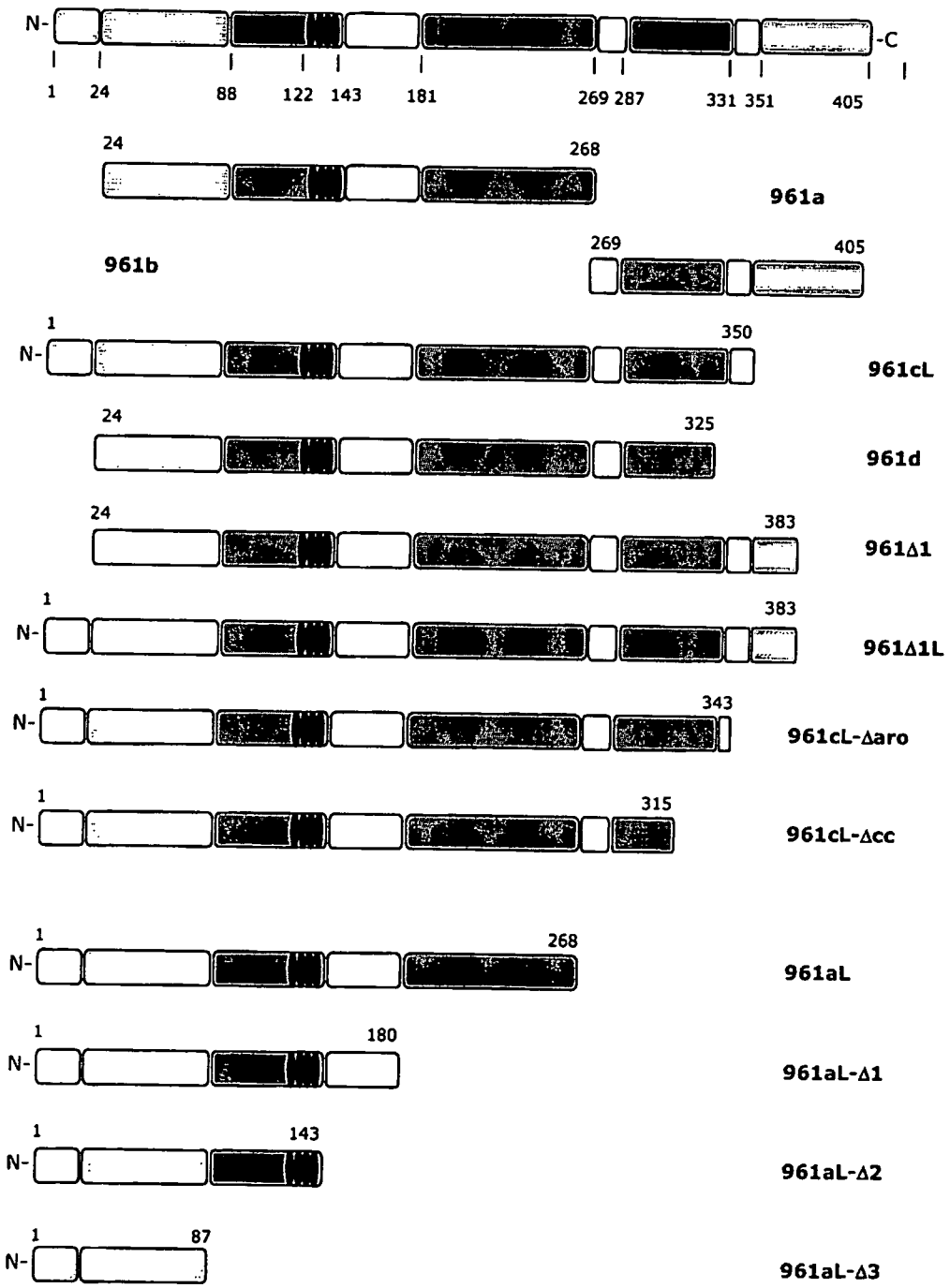
FIG. 5 shows how these have been manipulated.

FIGS. 4 and 5 show domains in protein 961.

When the anchor region (domain 9) of protein 961 is deleted ('961cL') and expressed in *E. coli*, the protein is exported in the periplasm and secreted in the supernatant of the culture.

To investigate this further, deletion mutants in the C-terminal region of 961 were constructed (961cL-Δaro, 961cLΔcc, 961aL, 961 aL-Δ1, 961aL-Δ2, 961aL-Δ3) on the basis of structural features (deletions of aromatic residues in the cases of 961cΔaro mutant, and of coiled-coil regions for the others). These were analysed for expression and secretion into the periplasm and the supernatant of the culture. In all of these deletion mutants, the protein is produced in large amount, is present in periplasmic fraction, and is released in the supernatant of the culture.

ΔG287—Cross-Strain Bactercidal Activity 287 was cloned for five different *N. meningitidis* serogroup B strains and was manipulated to delete the N-terminus up to the end of the poly-glycine region and to introduce a C-terminal his-tag. This gave five ΔG287 proteins. These were adjuvanted with FCA and used to raise immune sera in mice, which were then tested for bactericidal activity against all five serogroup B strains and also against serogroup A and C strains. Bactericidal titres were as follows:

| Protein strain | Sera tested for bactericidal activity against strain* | | | | | | |
|---|---|---|---|---|---|---|---|
| | 2996 | BZ232 | MC58 | 1000 | 394/98 | F6124 | BZ133 |
| 2996 | 16000 | 128 | 4096 | 4096 | 1024 | 8000 | 16000 |
| BZ232 | >8000 | 256 | 2048 | 8000 | 2048 | 16000 | 8000 |
| MC58 | >8000 | 64 | >8000 | 8000 | 2048 | 8000 | 8000 |
| 1000 | >8000 | 64 | 4096 | 8000 | 1024 | 16000 | 16000 |
| 394/98 | >16000 | 128 | 16000 | >2048 | >16000 | — | — |

*titres against homologous strain shown in bold

Refolding

To improve the levels of soluble protein for some hybrid proteins, alternative refolding protocols to those disclosed in reference 2 were adopted.

Inclusion bodies (IBs) were isolated as follows:
1. Homogenize cells (5 g wet weight) in 25 ml 0.1 M Tris-HCl pH 7, 1 mM EDTA, at 4° C. using an ultraturrax (10 000 rpm)
2. Add 1.5 mg lysozyme per gram cells, mix shortly with an ultraturrax, and incubate at 4° C. for 30 min.
3. Use sonication or high-pressure homogenization (French press) to disrupt the cells.
4. To digest DNA, add MgCl$_2$ to a final concentration of 3 mM and DNase to a final concentration of 10 μg/ml, and incubate for 30 min at 25° C.
5. Add 0.5 vol. 60 mM EDTA, 6% Triton X-100, 1,5M NaCl pH7, to the solution, and incubate for 30 min at 4° C.
6. Spin down inclusion bodies by centrifugation at 31000 g (20 000 rpm) for 10 min, 4° C.
7. Resuspend pellet in 40 ml 0.1 M tris-HCl pH 7, 20 mM EDTA, using an ultraturrax 8. Repeat centrifugation step 6.
9. The inclusion body pellet may be used, or stored frozen at −20° C.

Hybrid proteins were expressed in *E. coli* as follows:

| Protein | Culture volume (liters) | Flask volume (liters) | Temp (° C.) | Final $OD_{600}$ | Inclusion body yield (w/w) |
|---|---|---|---|---|---|
| ORF46.1-961-His | 1 | 2 | 37 | 1.51 | 33.2% |
| ORF46.1-961c-His | 1 | 2 | 37 | 1.6 | 28.3% |
| 961c-ORF46.1His | 1 | 2 | 37 | 1.18 | 23.5% |
| orf46.1-741 His | 5 | 5 | 37 | 12.42 | 35.2 |

The pellets were solubilised, refolded, ultrafiltered, dialysed, and protein was then purified:

ORF46.1-961-His

IBs were solubilised as follows: IB proteins were resuspended in 4 ml of 6M guanidine HCl, 1 mM EDTA pH 8.5 buffer, to a final protein concentration of 1 mg/ml. To refold the protein, 2 ml of solubilised protein was diluted in 400 ml of refolding buffer (0.1M Tris HCl, 1M L-arginine, 2 mM EDTA pH 8.2) and incubated for 1 hour at 15° C., resulting in a protein concentration of 5 µg/ml. Subsequently, another 2 ml of the solubilised protein was added and incubated for an additional hour at the same temperature resulting in a final protein concentration of 10 µg/ml. The material was ultrafiltered using a 300 ml Amicon ultrafiltration cell (8400), applying a 3 bar pressure on an Amicon membrane with a 30 kDa cut-off (YM30) resulting in 130 ml final volume. The ultrafiltered material was dialysed using a regenerated cellulose tubular membrane with a 12-14 kDa cutoff (Cellusep-Step bio) for 24 hours against 10 L of 0.1M Tris HCl pH 8.2 buffer. A second dialysis of 24 h against 10 L of 300 mM NaCl, 50 mM sodium phosphate pH 8.0 buffer was performed. The dialysed material was centrifuged at 22000 rpm for 45 minutes at 4° C. in a Beckman centrifuge rotor JA25.5 The supernatant isolated after centrifugation was used for His-tag purification.

orf 46.1-961c-His

IBs were solubilised as follows: IB proteins were resuspended in 4 ml of 6M guanidine HCl, 1 mM EDTA pH 8.5 buffer, to a final protein concentration of 1 mg/ml. To refold the protein, 2 ml of the solubilised protein was diluted in 400 ml refolding buffer (0.5M Tris HCl, 1M L-arginine, 2 mM EDTA pH 8.2) and incubated for 1 h at 15° C., resulting in a protein concentration of 5 µg/ml. Subsequently another 2 ml of the solubilised protein was added and incubated for an additional hour at the same temperature resulting in a final protein concentration of 10 µg/ml. The material was ultrafiltered using a 300 ml Amicon ultrafiltration cell (8400), applying a 3 bar pressure on an Amicon membrane with a 30 kDa cut-off (YM30) resulting in 150 ml final volume. The ultrafiltered material was dialysed using a regenerated cellulose tubular membrane with a 12-14 kDa cutoff (Cellusep-Step bio) for 24 h against 10 L of 0.1M Tris HCl pH 8.2 buffer. A second dialysis of 24 h against 10 L of 300 mM NaCl, 50 mM sodium phosphate pH 8.0 buffer was performed. The dialysed material was centrifuged at 22000 rpm for 45 minutes at 4° C. in a Beckman centrifuge rotor JA25.5. The supernatant isolated after centrifugation was used for His-tag purification.

961c-orf46.1-His

IBs were solubilised as follows: IB proteins were resuspended in 4 ml of 6M guanidine HCl, 1 mM EDTA pH 8.5 buffer, to a final protein concentration of 1 mg/ml. To refold the protein, 2 ml of the solubilised protein was diluted in 400 ml refolding buffer (0.1M Tris HCl, 0.5 M L-arginine, 2 mM EDTA pH 8.2) and incubated for 1 h at 15° C., resulting in a protein concentration of 5 µg/ml. Subsequently another 2 ml of the solubilized protein was added and incubated for an additional hour at the same temperature resulting in a final protein concentration of 10 µg/ml. The material was ultrafiltered using a 300 ml Amicon ultrafiltration cell (8400), applying a 3 bar pressure on an Amicon membrane with a 30 kDa cut-off (YM30) resulting in 150 ml final volume. The ultrafiltered material was dialysed using a regenerated cellulose tubular membrane with a 12-14 kDa cutoff (Cellusep-Step bio) for 24 h against 10 L of 0.1M Tris HCl pH 8.2 buffer. A second dialysis of 24 h against 10 L of 300 mM NaCl, 50 mM sodium phosphate pH 8.0 buffer was performed. The dialysed material was centrifuged at 22000 rpm for 45 minutes at 4° C. in a Beckman centrifuge rotor JA25.5. The supernatant isolated after centrifugation was used for His-tag purification.

orf46.1-741-His

IBs were solubilised as follows: IB proteins were resuspended in 4 ml of 6M guanidine HCl, 1 mM EDTA pH 8.5 buffer, to a final protein concentration of 10 mg/ml. To refold, 2 ml of the solubilised protein was diluted in 400 ml of the refolding buffer (0.5M Tris HCl, 0.7 M L-arginine, 2 mM EDTA pH 7.2) and incubated for 1 h at 15° C., resulting in a protein concentration of 50 µg/ml. Subsequently another 2 ml of the solubilised protein was added and incubated for an additional hour at the same temperature resulting in a final protein concentration of 100 µg/ml. The material was ultrafiltered using a 300 ml Amicon ultrafiltration cell (8400), applying a 3 bar pressure on an Amicon membrane with a 30 kDa cut-off (YM30) resulting in 120 ml final volume. The ultrafiltered material was dialysed using a regenerated cellulose tubular membrane with a 12-14 kDa cutoff (Cellusep-Step bio) for 24 h against 10 L of 0.1M Tris HCl pH 8.2 buffer. A second dialysis of 24 h against 10 L of 300 mM NaCl, 50 mM sodium phosphate pH 8.0 buffer was performed. The dialysed material was centrifuged at 22000 rpm for 45 minutes at 4° C. in a Beckman centrifuge rotor JA25.5 The supernatant isolated after centrifugation was used for His-tag purification.

Compared with proteins purified as described in ref. 2, bactericidal assay titres were as follows:

| | Reference 2 | | Refolded | | |
|---|---|---|---|---|---|
| Protein | CFA | Aluminium hydroxide | Aluminium hydroxide | MF59 | Aluminium phosphate |
| ORF46.1-961-His | 8192 | 8192 | 32768 | — | — |
| ORF46.1-961c-His | 8192 | 128 | <64 | 8192 | — |
| 961c-ORF46.1 His | 32768 | 1024 | 16384 | — | — |
| orf46.1-741 His | <4 | 16 | <4 | 256 | — |

Similar procedures were used for ORF46.1 to purify the protein from IBs when expressed with no His-tag ('ORF46.1 K'):

| Protein | Culture volume (liters) | Flask volume (liters) | Temp (° C.) | Final OD$_{600}$ | Inclusion body yield (w/w) |
|---|---|---|---|---|---|
| orf46.1K | 5 | 5 | 37 | 13.7 | 29.4 |

IB proteins were resuspended in 4 ml of 6M guanidine HCl, 1 mM EDTA pH 8.5 buffer, to a final protein concentration of 10 mg/ml. To refold, 2 ml of the solubilised protein was diluted in 400 ml of the refolding buffer (0.5M Tris HCl, 0.7 M L-arginine, 2 mM EDTA pH 7.2) and incubated for 1 hours at 15° C., resulting in a protein concentration of 50 µg/ml. Subsequently another 2 ml of the solubilised protein was added and incubated for an additional hour at the same temperature resulting in a final protein concentration of 100 µg/ml. The material was ultrafiltered using a 300 ml Amicon ultrafiltration cell (8400), applying a 3 bar pressure on an Amicon membrane with a 30 kDa cut-off (YM30) resulting in 120 ml final volume. The ultrafiltered material was dialysed using a regenerated cellulose tubular membrane with a 12-14 kDa cutoff (Cellusep-Step bio) for 12 h against 10 L of 50 mM sodium phosphate, 2 mM EDTA, pH 7.2 buffer. A second dialysis of 24 h against 10 L of the same buffer was performed. The dialysed material was centrifuged at 22000 rpm for 45 minutes at 4° C. in a Beckman centrifuge rotor JA25.5. The supernatant isolated after centrifugation was used for cationic exchange chromatography. The purification was done on a AKTA explorer chromatography system (Amersham-Pharmacia Biotech) using a 5 ml HiTrap SP sepharose HP column (Amersham-Pharmacia Biotech). The flow rate applied was of 1.5 ml per minute. The column was washed with 35 ml of 50 mM sodium phosphate buffer pH 7.2. A linear gradient (0-1 M NaCl) was performed using a 50 mM sodium phosphate buffer pH 7.2. The protein eluted in two peaks at 92 mM and 380 mM NaCl. The fractions constituting each peak were pooled and respectively named pool 1 and pool 2.

Compared with proteins purified as described in ref. 2, bactericidal assay titres when adjuvanted with aluminium hydroxide were improved from <4 to 1024. The titre using aluminium phosphate adjuvant with the refolded protein was 2048. ELISA titres were as follows:

| Protein | Aluminium adjuvant | Elisa (M7) | SBA (2996) |
|---|---|---|---|
| Orf46.1k (pool 1) | Hydroxide 3.3 mg/ml | 1212 | 512 |
| | Phosphate 0.6 mg/ml | 154 | 1024 |
| Orf46.1k (pool 2) | Hydroxide 3.3 mg/ml | 1085 | 1024 |
| | Phosphate 0.6 mg/ml | 250 | 1024 |

It will be understood that the invention has been described by way of example only and modifications may be made whilst remaining within the scope and spirit of the invention.

TABLE 1

| Strain | 1343 | Sequence | Strain classification |
|---|---|---|---|
| 72/00 | + | | ET5 B:15:P1.7, 13, 13a |
| 30/00 | + | | ET5 B:15:P1.7, 16 |
| 39/99 | + | | ET5 C:15:P1.7, 16 |
| 95330 | + | | ET5 B:4:P1.15 |
| M4102 | + | | ET5 nd |
| MC58(21) | + | + | ET5 B:15:P1.7, 16b |
| BZ169(7) | + | + | ET5 B:NT:P1.16 |
| BZ83(19) | + | | ET5 B:15:—.— |
| CU385 | + | + | ET5 B:4:P1.15 |
| 220173I | + | | ET5 NG:4:P1.15 |
| 64/96 | + | + | ET5 NG:15:P1.7, 16 (carrier) |
| 220173I | + | | ET5 B:4:P1.15 (carrier) |
| ISS107I | + | | nd B:15:P1.7, 16 (ET5?) |
| BZ198(2) | + | + | lin.3 B:8:P1.1 |
| 980-2543 | + | + | lin.3 B:NT:P1.4 |
| 16060 | + | + | other B:4:P1.14 (carrier) |
| 394-98 | + | | nd B:4:P1.4 (lin 3?) |
| ISS1106 | + | | nd B:4:P1.4 (lin.3?) |
| BZ133(10) | + | + | sub I B:NT:—.— |
| S3446 | + | + | nd B:14:P1.23, 14 |
| ISS1001 | + | + | nd B:14:P1.13 |
| 241175I | + | | other NG:21:P1.16 (carrier) |
| 171274I | + | | other NG:15:—(carrier) |
| 66/96 | + | | other B:17:P1.15 (carrier) |
| 961-5945 | − | | A4 |
| 96217 | − | | A4 |
| 312294 | − | | A4 |
| 90/18311(24) | − | | ET37 |
| 93/4286(25) | − | | ET37 |
| M986 | − | | ET37 |
| 1000(5) | − | | other |
| NGE28(13) | − | | other carrier |
| NGH38(14) | − | | other carrier |
| BZ232(18) | − | | other |
| F6124(23) | − | | sub III A:—.— |
| C11 | − | | C:— |
| NMB | − | | nd |
| 8047 | − | | nd |
| ISS759 | − | | nd C:2b:P1.2 |
| ISS1113 | − | | nd C:2:P1.5 |
| 65/96 | − | | nd 4:P1.14 |
| 2996(96) | − | | nd B:2b:P1.5, 2 |

REFERENCES

The Contents of which are Hereby Incorporated by Reference

1—International patent application WO01/64920.
2—International patent application WO01/64922.
3—International patent application WO99/24578.
4—International patent application WO99/36544.
5—International patent application WO99/57280.
6—International patent application WO00/22430.
7—Tettelin et al. (2000) *Science* 287:1809-1815.
8—International patent application WO00/66741.
9—International patent application WO00/71574.
10—International patent application WO01/04316
11—International patent application PCT/IB02/03396.
12—Comanducci et al. (2002) *J Exp Med* 195:1445-1454.
13—*Vaccine Design: subunit & adjuvant approach* (1995) Powell & Newman (ISBN: 030644867X).
14—International patent application WO01/52885.
15—Bjune et al. (1991) *Lancet* 338(8775):1093-1096.
16—Fukasawa et al. (1999) *Vaccine* 17:2951-2958.
17—Rosenqvist et al. (1998) *Dev. Biol. Stand.* 92:323-333.
18—Costantino et al. (1992) *Vaccine* 10:691-698.
19—Costantino et al. (1999) *Vaccine* 17:1251-1263.
20—International patent application PCT/IB02/03191.
21—Watson (2000) *Pediatr Infect Dis J* 19:331-332.
22—Rubin (2000) *Pediatr Clin North Am* 47:269-285, v.
23—Jedrzejas (2001) *Microbiol Mol Biol Rev* 65:187-207.
24—International patent application WO93/18150.
25—International patent application WO99/53310.
26—International patent application WO98/04702.
27—Bell (2000) *Pediatr Infect Dis J* 19:1187-1188.
28—Iwarson (1995) *APMIS* 103:321-326.

29—Gerlich et al. (1990) *Vaccine* 8 Suppl:S63-68 & 79-80.
30—Hsu et al. (1999) *Clin Liver Dis* 3:901-915.
31—Gustafsson et al. (1996) *N. Engl. J. Med.* 334:349-355.
32—Rappuoli et al. (1991) *TIBTECH* 9:232-238.
33—*Vaccines* (1988) eds. Plotkin & Mortimer. ISBN 0-7216-1946-0.
34—Del Guidice et al. (1998) *Molecular Aspects of Medicine* 19:1-70.
35—International patent application WO02/02606.
36—Kalman et al. (1999) *Nature Genetics* 21:385-389.
37—Read et al. (2000) *Nucleic Acids Res* 28:1397-406.
38—Shirai et al. (2000) *J. Infect. Dis.* 181(Suppl 3):S524S527.
39—International patent application WO99/27105.
40—International patent application WO00/27994.
41—International patent application WO00/37494.
42—International patent application WO99/28475.
43—Ross et al. (2001) *Vaccine* 19:4135-4142.
44—Sutter et al. (2000) *Pediatr Clin North Am* 47:287-308.
45—Zimmerman & Spann (1999) *Am Fam Physician* 59:113-118, 125-126.
46—Dreesen (1997) *Vaccine* 15 Suppl:S2-6.
47—*MMWR Morb Mortal Wkly Rep* 1998 Jan. 16; 47(1):12, 19.
48—McMichael (2000) *Vaccine* 19 Suppl 1:S101-107.
49—Schuchat (1999) *Lancet* 353(9146):51-6.
50—WO02/34771.
51—Dale (1999) *Infect Dis Clin North Am* 13:227-43, viii.
52—Ferretti et al. (2001) *PNAS USA* 98: 4658-4663.
53—Kuroda et al. (2001) *Lancet* 357(9264):1225-1240; see also pages 1218-1219.
54—Ramsay et al. (2001) *Lancet* 357(9251):195-196.
55—Lindberg (1999) *Vaccine* 17 Suppl 2:S28-36.
56—Buttery & Moxon (2000) *J R Coll Physicians Land* 34:163-168.
57—Ahmad & Chapnick (1999) *Infect Dis Clin North Am* 13:113-133, vii.
58—Goldblatt (1998) *J. Med. Microbiol.* 47:563-567.
59—European patent 0 477 508.
60—U.S. Pat. No. 5,306,492.
61—International patent application WO98/42721.
62—*Conjugate Vaccines* (eds. Cruse et al.) ISBN 3805549326, particularly vol. 10:48-114.
63—Hermanson (1996) *Bioconjugate Techniques* ISBN: 0123423368 or 012342335X.
64—European patent application 0372501.
65—European patent application 0378881.
66—European patent application 0427347.
67—International patent application WO93/17712.
68—International patent application WO98/58668.
69—European patent application 0471177.
70—International patent application WO00/56360.
71—International patent application WO00/61761.
72—Robinson & Torres (1997) *Seminars in Immunology* 9:271-283.
73—Donnelly et al. (1997) *Annu Rev Immunol* 15:617-648.
74—Scott-Taylor & Dalgleish (2000) *Expert Opin Investig Drugs* 9:471-480.
75—Apostolopoulos & Plebanski (2000) *Curr Opin Mol Ther* 2:441-447.
76—Ilan (1999) *Curr Opin Mol Ther* 1:116-120.
77—Dubensky et al. (2000) Mol Med 6:723-732.
78—Robinson & Pertmer (2000) *Adv Virus Res* 55:1-74.
79—Donnelly et al. (2000) *Am J Respir Crit Care Med* 162(4 Pt 2):S190-193.
80—Davis (1999) *Mt. Sinai J. Med.* 66:84-90.
81—Parkhill et al. (2000) *Nature* 404:502-506.

SEQUENCE LISTING (2207 sequences)

SEQ ID NO: 1 - protein, 279 aa, Neisseria meningitidis
MTRSKPVNRTAFCCLSLTAALILTACSSGGGGVAADIGAGLADALTTPLDHKDKSLQSLTLDQSVRKNEKLKLAAQGAEKTYGNGDSLNTGKLKNDKVSRFDFIRQIEVDGQTITLASGEFQIYKQNHSAVVALQIEKINNPDKIDSLINQRSFLVSGLGGEHTAFNQLPDGKAEYHGKAFSSDDPNGRLHYSIDFTKKQGYGRIEHLKTPEQNVELASAELKADEKSHAVILGDTRYGGEEKGTYHLALFGDRAQEIAGSATVKIREKVHEIGIAGKQ

SEQ ID NO: 2 - protein, 256 aa, Neisseria meningitidis
MTRSKPVNRTAFCCLSLTTALILTACSSGGGGVAADIGAGLADALTAPLDHKDKGLQSLTLDQSVRKNEKLKLAAQGAEKTYGNGDSLNTGKLKNDKVSRFDFIRQIEVDGQLITLESGEFQVYKQSHSALTAFQTEQIQDSEHSGKMVAKRQFRIGDIAGEHTSFDKLPEGGRATYRGTAFGSDDAGGKLTYTIDFAAKQGNGKIEHLKSPELNVDLAAADIKPDGKRHAVISGSVLYNQAEKGSYSLGIFGGKA

SEQ ID NO: 3 - protein, 234 aa, Neisseria meningitidis
GLADALTAPLDHKDKSLQSLTLDQSVRKNEKLKLAAQGAEKTYGNGDSLNTGKLKNDKVSRFDFIRQIEVDGQLITLESGEFQIYKQDHSAVVALQIEKINNPDKIDSLINQRSFLVSGLGGEHTAFNQLPSGKAEYHGKAFSSDDPNGRLHYSIDFTKKQGYGRIEHLKTPEQNVELASAELKADEKSHAVILGDTRYGGEEKGTYHLALFGDRAQEIAGSATVKIREKVHET

SEQ ID NO: 4 - protein, 247 aa, Neisseria meningitidis
VAADIGAGLADALTAPLDHKDKGLQSLMLDQSVRKNEKLKLAAQGAEKTYGNGDSLNTGKLKNDKVSRFDFIRQIEVDGQTITLASGEFQIYKQNHSAVVALQIEKINNPDKIDSLINQRSFLVSGLGGEHTAFNQLPDGKAEYHGKAFSSDDPNGRLHYSIDFTKKQGYGRIEHLKTPEQNVELASAELKADEKSHAVILGDTRYGGEEKGTYHLALFGDRAQEIAGSATVKIREKVHEIGIAGKQ

SEQ ID NO: 5 - protein, 279 aa, Neisseria meningitidis
MTRSKPVNRTAFCCLSLTAALILTACSSGGGGVAADIGAGLADALTAPLDHKDKSLQSLTLDQSVRKNEKLKLAAQGAEKTYGNGDSLNTGKLKNDKVSRFDFIRQIEVDGQLITLESGEFQIYKQDHSAVVALQIEKINNPDKIDSLINQRSFLVSGLGGEHTAFNQLPDGKAEYHGKAFSSDDAGGKLTYTIDFAAKQGHGKIEHLKTPEQNVELAAAELKADEKSHAVILGDTRYGSEEKGTYHLALFGDRAQEIAGSATVKIGEKVHEIGIAGKQ

SEQ ID NO: 6 - protein, 229 aa, Neisseria meningitidis
KDKGLQSLTLDQSVRKNEKLKLAAQGAEKTYGNGDSLNTGKLKNDKVSRFDFIRQIEVDGQLITLESGEFQVYKQSHSALTAFQTEQIQDSEHSGKMVAKRQFRIGDIAGEHTSFDKLPEGGRATYRGTAFGSDDAGGKLTYTIDFAAKQGNGKIEHLKSPELNVDLAAADIKPDGKRHAVISGSVLYNQAEKGSYSLGIFGGKAQEVAGSAEVKTVNGIRHIGLAAKQ

SEQ ID NO: 7 - protein, 279 aa, Neisseria meningitidis; identical to SEQ ID NO: 5

SEQ ID NO: 8 - protein, 228 aa, Neisseria meningitidis
DKGLQSLTLDQSVRKNEKLKLAAQGAEKTYGNGDSLNTGKLKNDKVSRFDFIRQIEVDGQLITLESGEFQVYKQSHSALTAFQTEQIQDSEHSGKMVAKRQFRIGDIAGEHTSFDKLPEGGRATYRGTAFGSDDAGGKLTYTIDFAAKQGNGKIEHLKSPELNVDLAAADIKPDGKRHAVISGSVLYNQAEKGSYSLGIFGGKAQEVAGSAEVKTVNGIRHIGLAAKQ

SEQ ID NO: 9 - protein, 279 aa, Neisseria meningitidis
MTRSKPVNRTAFCCLSLTAALILTACSSGGGGVAADIGAGLADALTAPLDHKDKGLQSLTLDQSVRKNEKLKLAAQGAEKTYGNGDSLNTGKLKNDKVSRFDFIRQIEVDGQLITLESGEFQIYKQDHSAVVALQIEKINNPDKIDSLINQRSFLVSGLGGEHTAFNQLPSGKAEYHGKAFSSDDPNGRLHYSIDFTKKQGYGRIEHLKTPEQNVELASAELKADEKSHAVILGDTRYGGEEKGTYHLALFGDRAQEIAGSATVKIREKVHEIGIAGKQ

SEQ ID NO: 10 - protein, 280 aa, Neisseria meningitidis
MTRSKPVNRTAFCCFSLTAALILTACSSGGGGVAADIGAGLADALTAPLDHKDKSLQSLTLDQSVRKNEKLKLAAQGAEKTYGNGDSLNTGKLKNDKVSRFDFIRQIEVDGQLITLESGEFQVYKQSHSALTALQTEQEQDPEHSGKMVAKRRFKIGDIAGEHTSFDKLPKDVMATYRGTAFGSDDAGGKLTYTIDFAAKQGHGKIEHLKSPELNVELATAYIKPDEKHHAVISGSVLYNQDEKGSYSLGIFGGQAQEVAGSAEVETANGIHHIGLAAKQ

SEQ ID NO: 11 - protein, 225 aa, Neisseria meningitidis
LQSLTLDQSVRKNEKLKLAAQGAEKTYGNGDSLNTGKLKNDKVSRFDFIRQIEVDGQLITLESGEFQVYKQSHSALTAFQTEQIQDSEHSGKMVAKRQFRIGDIAGEHTSFDKLPEGGRATYRGTAFGSDDAGGKLTYTIDFAAKQGNGKIEHLKSPELNVDLAAADIKPDGKRHAVISGSVLYNQAEKGSYSLGIFGGKAQEVAGSAEVKTVNGIRHIGLAAKQ

SEQ ID NO: 12 - protein, 225 aa, Neisseria meningitidis; identical to SEQ ID NO: 11

SEQ ID NO: 13 - protein, 280 aa, Neisseria meningitidis; identical to SEQ ID NO: 10

SEQ ID NO: 14 - protein, 279 aa, Neisseria meningitidis
MTRSKPVNRTAFCCLSLTAALILTACSSGGGGVAADIGAGLADALTAPLDHKDKSLQSLTLDQSVRKNEKLKLAAQGAEKTYGNGDSLNTGKLKNDKVSRFDFIRQIEVDGQLITLESGEFQIYKQDHSAVVALQIEKINNPDKIDSLINQRSFLVSGLGGEHTAFNQLPSGKAEYHGKAFSSDDPNGRLHYSIDFTKKQGYGRIEHLKTPEQNVELASAELKADEKSHAVILGDTRYGGEEKGTYHLALFGDRAQEIAGSATVKIREKVHEIGIAGKQ

SEQ ID NO: 15 - protein, 279 aa, Neisseria meningitidis; identical to SEQ ID NO: 5

SEQ ID NO: 16 - protein, 280 aa, Neisseria meningitidis
MTRSKPVNRTAFCCLSLTAALILTACSSGGGGVAADIGAGLADALTAPLDHKDKSLQSLTLDQSVRKNEKLKLAAQGAEKTYGNGDSLNTGKLKNDKVSRFDFIRQIEVDGQLITLESGEFQVYKQSHSALTALQTEQVQDSEHSGKMVAKRQFRIGDIAGEHTSFDKLPEGGRATYRGTAFGSDDASGKLTYTIDFAAKQGHGKIEHLKSPELNVDLAASDIKPDKKRHAVISGSVLYNQAEKGSYSLGIFGGQAQEVAGSAEVETANGIRHIGLAAKQ

SEQ ID NO: 17 - protein, 279 aa, Neisseria meningitidis
MTRSKPVNRTAFCCLSLTAALILTACSSGGGGVAADIGAGLADALTAPLDHKDKSLQSLTLDQSVRKNEKLKLAAQGAEKTYGNGDSLNTGKLKNDKVSRFDFIRQIEVDGQTITLASGEFQIYKQNHSAVVALQIEKINNPDKIDSLINQRSFLVSGLGGEHTAFNQLPDGKAEYHGKAFSSDDPNGRLHYSIDFTKKQGYGRIEHLKTPEQNVELASAELKADEKSHAVILGDTRYGGEEKGTYHLALFGDRAQEIAGSATVKIREKVHEIGIAGKQ

SEQ ID NO: 18 - protein, 279 aa, Neisseria meningitidis; identical to SEQ ID NO: 14

SEQ ID NO: 19 - protein, 279 aa, Neisseria meningitidis
MTRSKPVNRTAFCCLSLTAALILTACSSGGGGVAADIGAGLADALTAPLDHKDKSLQSLTLDQSVRKNEKLKLAAQGAEKTYGNGDSLNTGKLKNDKVSRFDFIRQIEVDGQLITLESGEFQIYKQDHSAVVALQIEKINNPDKIDSLINQRSFLVSGLGGEHTAFNQLPSGKAEYHGKAFSSDDAGGKLTYTIDFAAKQGHGKIEHLKTPEQNVELASAELKADEKSHAVILGDTRYGGEEKGTYHLALFGDRAQEIAGSATVKIREKVHEIGIAGKQ

SEQ ID NO: 20 - protein, 279 aa, Neisseria meningitidis; identical to SEQ ID NO: 1

SEQ ID NO: 21 - protein, 280 aa, Neisseria meningitidis; identical to SEQ ID NO: 16

SEQ ID NO: 22 - protein, 279 aa, Neisseria meningitidis; identical to SEQ ID NO: 17

SEQ ID NO: 23 - protein, 145 aa, Neisseria meningitidis
MGNFLYRGISCQQDEQNNGQLKPKGNKAEVAIRYDGKFKYDGKATHGPSVKNAVYAHQIETGLYDGCYISTTTDKEIAKKFATSSGIENGYIYVLNRDLFGQYSIFEYEVEHPENPNEKEVTLRAEDCGCIPEEVIIAKELIEIN

SEQ ID NO: 24 - protein, 150 aa, Neisseria gonorrhoeae
INNLWEISYLYRGISCQQDEQNNGQLKPKGNKAEVAIRYDGKFKYDGKATHGPSVKNAVYAHQIETDLYDGCYISTTTDKEIAKKFATSSGIENGYIYVLNRDLFGQYSIFEYEVEHPENPDEKEVTLRAEDCGCIPEEVIIAKELIEIN

SEQ ID NO: 25 - DNA, 634 bp, Neisseria gonorrhoeae
tccgccgcattaccttataaaataaaacatccctctcaagcagtctgataatgtttggattgcttgagattgatgagtgatggtgttaaattcaaactttaaattaataacttatgggaaatttcttatttatatagaggcattagttgccaacaagatgagcaaaataatggacagttaaaacctaaaggtaataaagctgaagttgcaattcgttatgatggtaagtttaaatatgatggtaaagctacacatggtccaagtgtgaagaatgcagtttacgcccatcaaattgaaacagatctatatgacggatgttatatatctacgacaacagacaaggaaattgccaagaaatttgcaacaagctccggcatcgaaaatggctatatatatgttttaaatagagatttgtttggtcaatattctatttttgaatatgaggttgaacatccagaaaacccagatgagaaggaagtaacaatcagagctgaagattgtggctgtattcctgaagaagtgattattgctaaagagttgatagaaattaactaagttgaaaggtcaatataatggctttagttgaattgaaagtgcccgacattggcggacacgaaaatgtagatattatcgc

SEQ ID NO: 26 - DNA, 630 bp, Neisseria meningitidis
tccgccgcattaccttataaaataaaacatccctctcaagcagtctgataatgtttggattgcttgagattgatgagtaatggtgttaaattcaacctttaaattaataacttatgggaaatttcttatatagaggcattagttgccaacaagatgagcaaaataatggacagttaaaacctaaaggtaataaagctgaagttgcaattcgttatgatggtaagtttaaatatgatggtaaagctacacatggtccaagtgtgaagaatgcagtttacgcccatcaaattgaaacaggtctatatgacggatgttatatatctacgacaacagacaaggaaattgccaagaaatttgcaacaagttccggcatcgaaaatggctatatatatgttttaaatagggatttgtttggtcaatattctatttttgaatatgaggttgaacatccagaaaacccaaatgagaaggaagtaacaatcagagctgaagattgtggctgtattcctgaagaagtgattattgctaaagagttgatagaaattaactaagttgaaaggtcaatataatggctttagttgaattgaaagtgcccgacattggcggacacgaaaatgtagatattatcgc

SEQ ID NO: 27 - DNA, 6 bp, Neisseria meningitidis
  Synthetic Construct
gsgggg

SEQ ID NO: 28 - protein, 579 aa, Artificial Sequence
  Synthetic Construct
MASPDVKSADTLSKPAAPVVAEKETEVKEDAPQAGSQGQGAPSTQGSQDMAAVSAENTGNGGAATTDKPKNEDEGPQNDMPQNSAESANQTGNNQPADSSDSAPASNPAPANGGSNFGRVDLANGVLIDGPSQNITLTHCKGDSCNGDNLLDEEAPSKSEFENLNESERIEKYKKDGKSDKFTNLVATAVQANGTNKYVIIYKDKSASSSSARFRRSARSRRSLPAEMPLIPVNQADTLIVDGEAVSLTGHSGNIFAPEGNYRYLTYGAEKLPGGSYALRVQGEPAKGEMLAGTAVYNGEVLHFHTENGRPYPTRGRFAAKVDFGSKSVDGIIDSGDDLHMGTQKFKAAIDGNGFKGTWTENGGGDVSGRFYGPAGEEVAGKYSYRPTDAEKGGFGVFAGKKEQDGSGGGGATYKVDEYHANARFAIDHFNTSTNVGGFYGLTGSVEFDQAKRDGKIDITIPVANLQSGSQHFTDHLKSADIFDAAQYPDIRFVSTKFNFNGKKLVSVDGNLTMHGKTAPVKLKAEKFNCYQSPMAKTEVCGGDFSTTIDRTKWGVDYLVNVGMTKSVRIDIQLEAAKQ

SEQ ID NO: 29 - protein, 644 aa, Artificial Sequence
  Synthetic Construct
MASPDVKSADTLSKPAAPVVSEKETEAKEDAPQAGSQGQGAPSAQGGQDMAAVSEENTGNGGAAATDKPKNEDEGAQNDMPQNAADTDSLTPNHTPASNMPAGNMENQAPDAGESEQPANQPDMANTADGMQGDDPSAGGENAGNTAAQGTNQAENNQTAGSQNPASSTNPSATNSGGDFGRTNVGNSVVIDGPSQNITLTHCKGDSCSGNNFLDEEVQLKSEFEKLSDADKISNYKKDGKNDGKNDKFVGLVADSVQMKGINQYIIFYKPKPTSFARFRRSARSRRSLPAEMPLIPVNQADTLIVDGEAVSLTGHSGNIFAPEGNYRYLTYGAEKLPGGSYALRVQGEPSKGEMLAGTAVYNGEVLHFHTENGRPSPSRGRFAAKVDFGSKSVDGIIDSGDGLHMGTQKFKAAIDGNGFKGTWTENGGGDVSGKFYGPAGEEVAGKYSYRPTDAEKGGFGVFAGKKEQDGSGGGGATYKVDEYHANARFAIDHFNTSTNVGGFYGLTGSVEFDQAKRDGKIDITIPVANLQSGSQHFTDHLKSADIFDAAQYPDIRFVSTKFNFNGKKLVSVDGNLTMHGKTAPVKLKAEKFNCYQSPMAKTEVCGGDFSTTIDRTKWGVDYLVNVGMTKSVRIDIQIEAAKQ

SEQ ID NO: 30 - protein, 456 aa, Artificial Sequence
  Synthetic Construct
MKPKPHTVRTLLAAIFSLALSGCVSAVIGSAAVGAKSAVDRRTTGAQTDDNVMALRIETTARSYLRQNNQTKGYTPQISVVGYNRHLLLLGQVATEGEKQFVGQIARSEQAAEGVYNYITVASLPRTAGDIAGDTWNTSKVRATLLGISPATQARVKIVTYGNVTYVMGILTPEEQAQITQKVSTTVGVQKVITLYQNYVQRGSGGGGVAADIGAGLADALTAPLDHKDKGLQSLTLDQSVRKNEKLKLAAQGAEKTYGNGDSLNTGKLKNDKVSRFDFIRQIEVDGQLITLESGEFQVYKQSHSALTAFQTEQIQDSEHSGKMVAKRQFRIGDIAGEHTSFDKLPEGGRATYRGTAFGSDDAGGKLTYTIDFAAKQGNGKIEHLKSPELNVDLAAADIKPDGKRHAVISGSVLYNQAEKGSYSLGIFGGKAQEVAGSAEVKTVNGIRHIGLAAKQ

SEQ ID NO: 31 - protein, 327 aa, Neisseria meningitidis
MTNDDDVKKAATVALAAAYNNGQEINGFKAGETIYDIDEDGTITKKDATAADVEADDFKGLGLKKVVTNLTKTVNENKQNVDAKVKAAESEIEKLTTKLADTDAALADTDAALDATTNALNKLGENITTFAEETKTNIVKIDEKLEAVADTVDKHAEAFNDIADSLDETNTKADEAVKTANEAKQTAEETKQNVDAKVKAAETAAGKAEAAAGTANTAADKAEAVAAKVTDLKADIATNKDNIAKKANSADVYTREESDSKFVRIDGLNATTEKLDTRLASAEKSIADHDTRLNGLDKTVSDLRKETRQGLAEQAALSGLFQPYNVG

SEQ ID NO: 32 - protein, 168 aa, Neisseria
  VARIANT (1)...(168): Xaa = Any Amino Acid
MKQTVXMLAAALIALGLNRPVWXDDVSDFRENLXAAAQGNAAAQYNLGAMYXQRTRVRRDDAEAVRWYRQPAEQGLAQAQYNLGWMYANGRXVRQDDTEAVRWYRQAAAQGVVQAQYNLGVIYAEGRGVRQDDVEAVRWFRQAAAQGVAQAQNNLGVMYAERXRVRQD

SEQ ID NO: 33 - protein, 198 aa, Neisseria
MKQTVKWLAAALIALGLNRAVWADDVSDFRENLQAAAQGNAAAQYNLGAMYYKGRGVRRDDAEAVRWYRQAAEQGLAQAQYNLGWMYANGRGVRQDDTEAVRWYRQAAAQGVVQAQYNLGVIYAEGRGVRQDDVEAVRWFRQAAAQGVAQAQNNLGVMYAERRGVRQDRALAQEWFGKACQNGDQDGCDNDQRLKAGY

SEQ ID NO: 34 - protein, 90 aa, Neisseria
MKQTVKWLAAALIALGLNQAVWADDVSDFRENLQAAAQGNAAAQNNLGVMYAERRGVRQDRALAQEWLGKACQNGYQDSCDNDQRLKAGY

SEQ ID NO: 35 - protein, 126 aa, Neisseria
MKQTVKWLAAALIALGLNQAVWAGDVSDFRENLQAAEQGNAAAQFNLGVMYENGQGVRQDYVQAVQWYRKASEQGDAQAQYNLGLMYYDGRGVRQDLALAQQWLGKACQNGDQNSCDNDQRLKAGY

SEQ ID NO: 36 - protein, 118 aa, Neisseria
FGDIGGLKVNAPVKSAGVLVGRVGAIGLDPKSYQARVRLDLDGKYQFSSDVSAQILTSGLLGEQYIGLQQGGDTENLAAGDTISVTSSAMVLENLIGKFMTSFAEKNADGGNAEKAAE

SEQ ID NO: 37 - protein, 286 aa, Neisseria
  VARIANT (1)...(286): Xaa = Any Amino Acid
ILIYLIRKNLGSPVFFFQERPGKDGKPFKMVKFRSMRDGLYSDGIPLPDGERLTPFGKKLRAASXDELPELWNILKGEMSLVGPRPLLMQYLPLYDNFQNRRHEMKPGITGWAQVNGRNALSWDEKFACDVWYIDHFSLCLDIKILLLTVKKVLIKEGISAQGEXTMPPFTGKRKLAVVGAGGHGKVVADLAAALGRYREIVFLDDRAQGSVNGFSVIGTTLLLENSLSPEQYDVAVAVGNNRIRRQIAEKAAALGFALPVLVHPDATVSPSATVGQGSVVMAKAV

SEQ ID NO: 38 - protein, 413 aa, Neisseria
MSKFFKRLFDIVASASGLIFLSPVFLILIYLIRKNLGSPVFFFQERPGKDGKPFKMVKFRSMRDALDSDGIPLPDGERLTPFGKKLRAASLDELPELWNILKGEMSLVGPRPLLMQYLPLYDNFQNRRHEMKPGITGWAQVNGRNALSWDEKFACDVWYIDHFSLCLDIKILLLTVKKVLIKEGISAQGEATMPPFTGKRKLAVVGAGGHGKVVADLAAALGRYREIVFLDDRAQGSVNGFSVIGTTLLLENSLSPEQYDVAVAVGNNRIRRQIAEKAAALGFALPVLVHPDATVSPSATVGQGSVVMAKAVVQAGSVLKDGVIVNTAATVDHDCLLNAFVHISPGAHLSGNTHIGEESWIGTGACSRQQIRIGSRATIGAGAVVVRDVSDGMTVAGNPAKPLPRKNPETSTA

SEQ ID NO: 39 - protein, 413 aa, Neisseria
MSKFFKRLFDIVASASGLIFLSPVFLILIYLIRKNLGSPVFFFQERPGKDGKPFKMVKFRSMHDALDSDGILLPDGERLTPFGKKLRAASLDELPELWNVLKGDMSLVGPRPLLMQYLPLYDNFQNRRHEMKPGITGWAQVNGRNALSWDERFACDIWYIDHFSLCLDIKILLLTVKKVLIKEGISAQGEATMPPFTGKRKLAVVGAGGHGKVVAELAAALGTYGEIVFLDDRVQGSVNGFPVIGTTLLLENSLSPEQFDIAVAVGNNRIRRQIAEKAAALGFALPVLIHPDSTVSPSATVGQGGVVMAKAVVQADSVLKDGVIVNTAATVDHDCLLDAFVHISPGAHLSGNTRIGEESWIGTGACSRQQIRIGSRATIGAGAVVVRDVSDGMTVAGNPAKPLAGKNTETLRS

SEQ ID NO: 40 - protein, 413 aa, Neisseria
MSKAVKRLFDIIASASGLIVLSPVFLVLIYLIRKNLGSPVFFIRERPGKDGKPFKMVKFRSMRDALDSDGIPLPDSERLTDFGKKLRATSLDELPELWNVLKGEMSLVGPRPLLMQYLPLYNKFQNRRHEMKPGITGWAQVNGRNALSWDEKFSCDVWYTDNFSFWLDMKILFLTVKKVLIKEGISAQGEATMPPFAGNRKLAVIGAGGHGKVVAELAAALGTYGEIVFLDDRTQGSVNGFPVIGTTLLLENSLSPEQFDITVAVGNNRIRRQITENAAALGFKLPVLIHPDATVSPSAIIGQGSVVMAKAVVQAGSVLKDGVIVNTAATVDHDCLLDAFVHISPGAHLSGNTRIGEESRIGTGACSRQQTTVGSGVTAGAGAVIVCDIPDGMTVAGNPAKPLTGKNPKTGTA

SEQ ID NO: 41 - protein, 135 aa, Neisseria
  VARIANT (1)...(135): Xaa = Any Amino Acid
NHMAIVIDEYGGTSGLVTFEDIIEQIVGEIEDEFDEDDSADNIHAVSSDTWRIHAATEIEDINTFFGTEYSIEEADTIXRPGHSRVGTSARARRKSPYRRFAVHRRTRRQPPPAYADGDPREVSXXXXXRRFCTV

SEQ ID NO: 42 - protein, 299 aa, Neisseria
MDGAQPKTNFFERLIARLAREPDSAEDVLNLLRQAHEQEVFDADTLLRLEKVLDFSDLEVRDAMITRSRMNVLKENDSIERITAYVIDTAHSRFPVIGEDKDEVLGILHAKDLLKYMFNPEQFHLKSILRPAVFVPEGKSLTALLKEFREQRNHMAIVIDEYGGTSGLVTFEDIIEQIVGEIEDEFDEDDSADNIHAVSSERWRIHAATEIEDINTFFGTEYSSEEADTIRPGHSRVGTSARARRKSPYRRFAVHRRTRRQPPPAYADGDPREVSTAVSAQFRMTVRAFSVSIRPIRQT

SEQ ID NO: 43 - protein, 300 aa, Neisseria
  VARIANT (1)...(300): Xaa = Any Amino Acid
MDGAQPKTNFXXRLIARLAREPDSAEDVLTLLRQAHEQEVFDADTLLRLEKVLDFSDLEVRDAMITRSRMNVLKENDSIERITAYVIDTAHSRFPVIGEDKDEVLGILHAKDLLKYMFNPEQFHLKSILRPAVFVPEGKSLTALLKEFREQRNHMAIVIDEYGGTSGLVTFEDIIEQIVGDIEDEFDEDESADNIHAVSAERWRIHAATEIEDINAFFGTEYSSEEADTIGGXGHSGIGTPARARRKSXYRRXAXHXRXRXQPPPAYADGDPREVSSAVSVQFRMTVRAFSVSIRPIRXT

SEQ ID NO: 44 - protein, 287 aa, Neisseria
MDGAQPKTNFFERLIARLAREPDSAEDVLNLLRQAHEQEVFDADTLTRLEKVLDFAELEVRDAMITRSRMNVLKENDSIERITAYVIDTAHSRFPVIGEDKDEVLGILHAKDLLKYMFNPEQFHLKSVLRPAVFVPEGKSLTALLKEFREQRNHMAIVIDEYGGTSGLVTFEDIIEQIVGDIEDEFDEDESADDIHSVSAERWRIHAATEIEDINAFFGTEYGSEEADTIRRLGHSGIGTPARARRKSPYRRFAVHRRPRRQPPPAHADGDPREVSRACPHRRFCTV

SEQ ID NO: 45 - protein, 304 aa, Neisseria
MDGAQPKTNFFERLIARLAREPDSAEDVLNLLRQAHEQEVFDADTLTRLEKVLDFAELEVRDAMITRSRMNVLKENDSIERITAYVIDTAHSRFPVIGEDKDEVLGILHAKDLLKYMFNPEQFHLKSVLRPAVFVPEGKSLTALLKEFREQRNHMAIVIDEYGGTSGLVTFEDIIEQIVGDIEDEFDEDESADDIHSVSAERWRIHAATEIEDINAFFGTEYGSEEADTIRRLGHSGIGTPARARRKSPYRRFAVHRRPRRQPPPAHADGDPREVSRACPTAVSAQFRMTVRSFSVSIRPIRQT

SEQ ID NO: 46 - protein, 187 aa, Neisseria
  VARIANT (1)...(187): Xaa = Any Amino Acid
MRGGRPDSVTVQIIEGSRFSHMRKVIDATPDIGHDTKGWSNEKLMAEVAPDAFSGNPEGQFFPDSYEIDAGGSDLQIYQTAYKAMQRRLNEAWESRQDGLPYKNPYEMLIMAXLVEKETGHEAXXDHVASVFVNRLKIGMRLQTXXSVIYGMGAAYKGKIRKADLRRDTPYNTYTRGGLPPTPIALP

SEQ ID NO: 47 - protein, 331 aa, Neisseria
MLRKLLKWSAVFLTVSAAVFAALLFVPKDNGRAYRIKIAKNQGISSVGRKLAEDRIVFSRHVLTAAAYVLGVHNRLHTGTYRLPSEVSAWDILQKMRGGRPDSVTVQIIEGSRFSHMRKVIDATPDIGHDTKGWSNEKLMAEVAPDAFSGNPEGQFFPDSYEIDAGGSDLQIYQTAYKAMQRRLNEAWESRQDGLPYKNPYEMLIMASLVEKETGHEADRDHVASVFVNRLKIGMRLQTDPSVIYGMGAAYKGKIRKADLRRDTPYNTYTRGGLPPTPIALPGKAALDAAAHPSGEKYLYFVSKMDGTGLSQFSHDLTEHNAAVRKYILKK

SEQ ID NO: 48 - protein, 331 aa, Neisseria
MLRKLLKWSAVFLTVSAAVFAALLFVPKDNGRAYRIKIAKNQGISSVGRKLAEDRIVFSRHVLTAAAYVLGVHNRLHTGTYRLPSEVSAWDILQKMRGGRPDSVTVQIIEGSRFSHMRKVIDATPDIEHDTKGWSNEKLMAEVAPDAFSGNPEGQFFPDSYEIDAGGSDLRIYQIAYKAMQRRLNEAWESRQDGLPYKNPYEMLIMASLIEKETGHEADRDHVASVFVNRLKIGMRLQTDPSVIYGMGAAYKGKIRKADLRRDTPYNTYTRGGLPPTPIALPGKAALDAAAHPSGEKYLYFVSKMDGTGLSQFSHDLTEHNAAVRKYILKK

SEQ ID NO: 49 - protein, 236 aa, Neisseria
MRGGRPDSVTVQIIEGSRFSHMRKVIDATPDIGHDTKGWSNEKLMAEVAPDAFSGNPEGQFFPDSYEIDAGGSDLQIYQTAYKAMQRRLNEAWAGRQDGLPYKNPYEMLIMASLIEKETGHEADRDHVASVFVNRLKIGMRLQTDPSVIYGMGAAYKGKIRKADLRRDTPYNTYTGGGLPPTRIALPGKAAMDAAAHPSGEKYLYFVSKMDGTGLSQFSHDLTEHNAAVRKYILKK

SEQ ID NO: 50 - protein, 298 aa, Neisseria
YRIKIAKNQGISSVGRKLAEDRIVFSRHVLTAAAYVLGVHNRLHTGTYRLPSEVSAWDILQKMRGGRPDSVTVQIIEGSRFSHMRKVIDATPDIGHDTKGWSNEKLMAEVAPDAFSGNPEGQFFPDSYEIDAGGSDLQIYQTAYKAMQRRLNEAWAGRQDGLPYKNPYEMLIMASLIEKETGHEADRDHVASVFVNRLKIGMRLQTDPSVIYGMGAAYKGKIRKADLRRDTPYNTYTGGGLPPTRIALPGKAAMDAAAHPSGEKYLYFVSKMDGTGLSQFSHDLTEHNAAVRKYILKK

SEQ ID NO: 51 - protein, 166 aa, Neisseria
RFKMLTVLTATLIAGQVSAAGGGAGDMKQPKEVGKVFRKQQRYSEEEIKNERARLAAVGERVNQIFTLLGGETALQKGQAGTALATYMLMLERTKSPEVAERALEMAVSLNAFEQAEMIYQKWRQIEPIPGKAQKRAGWLRNVLRERGNQHLDGREEVLAQADEGQ

SEQ ID NO: 52 - protein, 614 aa, Neisseria
MLPNRFKMLTVLTATLIAGQVSAAGGGAGDMKQPKEVGKVFRKQQRYSEEEIKNERARLAAVGERVNQIFTLLGGETALQKGQAGTALATYMLMLERTKSPEVAERALEMAVSLNAFEQAEMIYQKWRQIEPIPGKAQKRAGWLRNVLRERGNQHLDGLEEVLAQADEGQNRRVFLLLAQAAVQQDGLAQKASKAVRRAALKYEHLPEAAVADVVFSVQGREKEKAIGALQRLAKLDTEILPPTLMTLRLTARKYPEILDGFFEQTDTQNLSAVWQEMEIMNLVSLHRLDDAYARLNVLLERNPNADLYIQAAILAANRKEGASVIDGYAEKAYGRGTEEQRSRAALTAAMMYADRRDYAKVRQWLKKVSAPEYLFDKGVLAAAAAVELDGGRAALRQIGRVRKLPEQQGRYFTADNLSKIQMLALSKLPDKREALRGLDKIIEKPPAGSNTELQAEALVQRSVVYDRLGKRKKMISDLERAFRLAPDNAQIMNNLGYSLLTDSKRLDEGFALLQTAYQINPDDTAVNDSIGWAYYLKGDAESALPYLRYSFENDPEPEVAAHLGEVLWALGERDQAVDVWTQAAHLTGDKKIWRETLKRHGIALPQPSRKPRK

SEQ ID NO: 53 - protein, 612 aa, Neisseria
  VARIANT (1)...(612): Xaa = Any Amino Acid
MLPARFTILSVLAAALLAGQAYAAGAADAKPPKEVGKVFRKQQRYSEEEIKNERARLAAVGERVNQIFTLLGXETALQKGQAGTALATYMLMLERTKSPEVAERALEMAVSLNAFEQAEMIYQKWRQIEPIPGKAQKRAGWLRNVLRERGNQHLDGLEEXLAQADEXQNRRVFLLLAQAAVQQDGLAQKASKAVRRAALRYEHLPEAAVADVVFSVQXREKEKAIGALQRLAKLDTEILPPTLMTLRLTARKYPEILDGFFEQTDTQNLSAVWQEMEIMNLVSLHRLDDAYARLNVLLERNPNADLYIQAAILAANRKEXASVIDGYAEKAYGRGTGEQRGRAAMTAAMIYADRRDYTKVRQWLKKVSAPEYLFDKGVLAAAAAVELDXGRAALRQIGRVRKLPEQQGRYFTADNLSKIQMFALSKLPDKREALRGLDKIIEKPPAGSNTELQAEALVQRSVVYDRLGKRKKMISDLERAFRLAPDNAQIMNNLGYSLLSDSKRLDEGFALLQTAYQINPDDTAVNDSIGWAYYLKXDAESALPYLRYSFENDPEPEVAAHLGEVLWALGERDQAVDVWTQAAHLTGDKKIWRETLKRHGIALPQPSRKPRK

SEQ ID NO: 54 - protein, 300 aa, Neisseria
MIMLPARFTILSVLAAALLAGQAYAAGAADVELPKEVGKVLRKHRRYSEEEIKNERARLAAVGERVNRVFTLLGGETALQKGQAGTALATYMLMLERTKSPEVAERALEMAVSLNAFEQAEMIYQKWRQIEPIPGEAQKPAGWLRNVLKEGGNPHLDRLEEVPAQSDYVHQPMIFLLLVQAAVQHGGVAQKPSKAVRPAAYNYEVLPETAGADAVFCVQGPQYEKAIQSFPPCGRNPQTENIAPPFNELFRPTARPISPKLLQRFFRTEPNLAKPFRPPGPEMETYQTGFPRPLTRNNPT

SEQ ID NO: 55 - protein, 612 aa, Neisseria
MLPARFTILSVLAAALLAGQAYAAGAADVELPKEVGKVLRKHRRYSEEEIKNERARLAAVGERVNRVFTLLGGETALQKGQAGTALATYMLMLERTKSPEVAERALEMAVSLNAFEQAEMIYQKWRQIEPIPGEAQKPAGWLRNVLKEGGNQHLDGLKEVLAQSDDVQKRRIFLLLVQAAVQQGGVAQKASKAVRRAALKYEHLPEAAVADAVFGVQGREKEKAIEALQRLAKLDTEILPPTLMTLRLTARKYPEILDGFFEQTDTQNLSAVWQEMEIMNLVSLRKPDDAYARLNVLLEHNPNANLYIQAAILAANRKEGASVIDGYAEKAYGRGTGEQRGRAAMTAAMIYADRRDYAKVRQWLKKVSAPEYLFDKGVLAAAAAAELDGGRAALRQIGRVRKLPEQQGRYFTADNLSKIQMLALSKLPDKREALIGLNNIIAKLSAAGSTEPLAEALAQRSIIYEQFGKRGKMIADLETALKLTPDNAQIMNNLGYSLLSDSKRLDEGFALLQTAYQINPDDTAVNDSIGWAYYLKGDAESALPYLRYSFENDPEPEVAAHLGEVLWALGERDQAVDVWTQAAHLRGDKKIWRETLKRYGIALPEPSRKPRK

SEQ ID NO: 56 - protein, 240 aa, Neisseria
  VARIANT (1)...(240): Xaa = Any Amino Acid
NLYAGPQTTSVIANIADNLQLAKDYGKVHWFASPLFWLLNQLHNIIGNWGWAIIVLTIIVKAVLYPLTNASYRSMAKMRAAAPKLQAIKEKYGDDRMAQQQAMMQLYTDEKINPLGGCLPMLLQIPVFIGLYWALFASVELRQAPWLGWITDLSRADPYYILPIIMAATMFAQTYLNPPPTDPMQAKMMKIMPLVFSXXFFFFPAGXVLYWVVNNLLTIAQQWHINRSIEKQRAQGEVVS

SEQ ID NO: 57 - protein, 545 aa, Neisseria
MDFKRLTAFFAIALVIMIGWEKMFPTPKPVPAPQQAAQQQAVTASAEAALAPATPITVTTDTVQAVIDEKSGDLRRLTLLKYKATGDENKPFILFGDGKEYTYVAQSELLDAQGNNILKGIGFSAPKKQYSLEGDKVEVRLSAPETRGLKIDKVYTFTKGSYLVNVRFDIANGSGQTANLSADYRIVRDHSEPEGQGYFTHSYVGPVVYTPEGNFQKVSFSDLDDDAKSGKSEAEYIRKTPTGWLGMIEHHFMSTWILQPKGRQSVCAAGECNIDIKRRNDKLYSTSVSVPLAAIQNGAKAEASINLYAGPQTTSVIANIADNLQLAKDYGKVHWFASPLFWLLNQLHNIIGNWGWAIIVLTIIVKAVLYPLTNASYRSMAKMRAAAPKLQAIKEKYGDDRMAQQQAMMQLYTDEKINPLGGCLPMLLQIPVFIGLYWALFASVELRQAPWLGWITDLSRADPYYILPIIMAATMFAQTYLNPPPTDPMQAKMMKIMPLVFSVMFFFFPAGLVLYWVVNNLLTIAQQWHINRSIEKQRAQGEVVS

SEQ ID NO: 58 - protein, 545 aa, Neisseria
  VARIANT (1)...(545): Xaa = Any Amino Acid
XDFKRLTXFFAIALVIMIGXXXMFPTPKPVPAPQQTAQQQAVXASAEAALAPXXPITVTTDTVQAVIDEKSGDLRRLTLLKYKATGDXNKPFILFGDGKXYTYXAXSELLDAQGNNILKGIGFSAPKKQYSLEGDKVEVRLSAPETRGLKIDKVYTFTKGSYLVNVRFDIANGSGQTANLSADYRIVRDHSEPEGQGYFTHSYVGPVVYTPEGNFQKVSFSDLDDDAXSGKSEAEYIRKTXTGWLGMIEHHFMSTWILQPKGGQSVCAAGDCXXDIKRRNDKLYSTSVSVPLAAIQNGAKSXASINLYAGPQTTSVIANIADNLQLXKDYGKVHWFASPLFWLLNQLHNIIGNWGWAIIVLTIIVKAVLYPLTNASYRSMAKMRAAAPKLQAIKEKYGDDRMAQQQAMMQLYTDEKINPLGGCLPMLLQIPVFIGLYWALFASVELRQAPWLGWITDLSRADPYYILPIIMAATMFAQTYLNPPPTDPMQAKMMKIMPLVXSXXFFXFPAGLVLYWVINNLLTIAQQWHINRSIEKQRAQGEVVS

SEQ ID NO: 59 - protein, 243 aa, Neisseria
MAVNLYAGPQTTSVIANIADNLQLAKDYGKVHWFASPLFWLLNQLHNIIGNWGWAIVVLTIIVKAVLYPLTNASYRSMAKMRAAAPELQTIKEKYGDDRMAQQQAMMQLFEDEEINPLGGCLPMLLQIPVFIGLYWALFASVELRQAPWLGWITDLSRADPYYILPIIMAATMFAQTYLNPPPTDPMQAKMMKIMPLVFSVMFFFFPAGLVLYWVVNNLLTIAQQWHINRSIEKQRAQGEVVS

SEQ ID NO: 60 - protein, 546 aa, Neisseria
MDFKRLTAFFAIALVIMIGWEKMFPTPKPVPAPQQAAQKQAATASAEAALAPATPITVTTDTVQAVIDEKSGDLRRLTLLKYKATGDENKPFVLFGDGKEYTYVAQSELLDAQGNNILKGIGFSAPKKQYTLNGDTVEVRLSAPETNGLKIDKVYTFTKDSYLVNVRFDIANGSGQTANLSADYRIVRDHSEPEGQGYFTHSYVGPVVYTPEGNFQKVSFSDLDDDAKSGKSEAEYIRKTPTGWLGMIEHHFMSTWILQPKGGQNVCAQGDCRIDIKRRNDKLYSASVSVPLTAIPTRGPKPKMAVNLYAGPQTTSVIANIADNLQLAKDYGKVHWFASPLFWLLNQLHNIIGNWGWAIVVLTIIVKAVLYPLTNASYRSMAKMRAAAPKLQTIKEKYGDDRMAQQQAMMQLYKDEKINPLGGCLPMLLQIPVFIGLYWALFASVELRQAPWLGWITDLSRADPYYILPIIMAATMFAQTYLNPPPTDPMQAKMMKIMPLVFSVMFFFFPAGLVLYWVVNNLLTIAQQWHINRSIEKQRAQGEVVS

SEQ ID NO: 61 - protein, 126 aa, Neisseria
  VARIANT (1)...(126): Xaa = Any Amino Acid
AVLIIELLTGTVYLLVVSAALAGSGIAYGLTGSTPAAVLTXALLSALGIXFVHAKTAVRKVETDSYQDLDAGQYVEILRHTGGNRYEVXYRGTXWQAQNTGQEELEPGTRALIVRKEGNLLIITHP

SEQ ID NO: 62 - protein, 126 aa, Neisseria
  VARIANT (1)...(126): Xaa = Any Amino Acid
AVLIIELLTGTVYLLVVSAALAGSGIAYGLTGSTPAAVLTXALLSALGIXFVHAKTAVRKVETDSYQDLDAGQYVEILRHTGGNRYEVFYRGTHWQAQNTGQEELEPGTRALIVRKEGNLLIITHP

SEQ ID NO: 63 - protein, 135 aa, Neisseria
MTVWFVAAVAVLIIELLTGTVYLLVVSAALAGSGIAYGLTGSTPAAVLTAALLSALGIWFVHAKTAVGKVETDSYQDLDAGQYAEILRHAGGNRYEVFYRGTHWQAQNTGQEELEPGTRALIVRKEGNLLIIAKP

SEQ ID NO: 64 - protein, 135 aa, Neisseria
MTVWFVAAVAVLIIELLTGTVYLLVVSAALAGSGIAYGLTGSTPAAVLTAALLSALGIWFVHAKTAVGKVETDSYQDLDTGKYAEILRYTGGNRYEVFYRGTHWQAQNTGQEVFEPGTRALIVRKEGNLLIIANP

SEQ ID NO: 65 - protein, 136 aa, Neisseria
  VARIANT (1)...(136): Xaa = Any Amino Acid
MXDFGLGELVFVGIIALIVLGPERXPEAARXAGRLIGRLQRFVGSVKQEFDTQIELEELRKAKQEFEAAAAQVRDSLKETGTDMEGNLHDISDGLKPWEKLPEQRTPADFGVDENGNPXSRCGKHPIRRHFRRYAV

SEQ ID NO: 66 - protein, 228 aa, Neisseria
MFDFGLGELVFVGIIALIVLGPERLPEAARTAGRLIGRLQRFVGSVKQEFDTQIELEELRKAKQEFEAAAAQVRDSLKETGTDMEGNLHDISDGLKPWEKLPEQRTPADFGVDENGNPLPDAANTLSDGISDVMPSERSYASAETLGDSGQTGSTAEPAETDQDRAWREYLTASAAAPVVQTVEVSYIDTAVETPVPHTTSLRKQAISRKRDFRPKHRAKPKLRVRKS

SEQ ID NO: 67 - protein, 228 aa, Neisseria
MFDFGLGELVFVGIIALIVLGPERLPEAARTAGRLIGRLQRFVGSVKQEFDTQIELEELRKAKQEFEAAAAQVRDSLKETGTDMEGNLHDISDGLKPWEKLPEQRTPADFGVDENGNPFPDAANTLLDGISDVMPSERSYASAETLGDSGQTGSTAEPAETDQDRAWREYLTASAAAPVVQTVEVSYIDTAVETPVPHTTSLRKQAISRKRDLRPKSRAKPKLRVRKS

SEQ ID NO: 68 - protein, 136 aa, Neisseria
MFDFGLGELIFVGIIALIVLGPERLPEAARTAGRLIGRLQRFVGSVKQELDTQIELEELRKVKQAFEAAAAQVRDSLKETDTDMQNSLHDISDGLKPWEKLPEQRTPADFGVDEKGNSLSRYGKHRIRRHFRRYAV

SEQ ID NO: 69 - protein, 229 aa, Neisseria
MFDFGLGELIFVGIIALIVLGPERLPEAARTAGRLIGRLQRFVGSVKQELDTQIELEELRKVKQAFEAAAAQVRDSLKETDTDMQNSLHDISDGLKPWEKLPEQRTPADFGVDENGNPLPDTANTVSDGISDVMPSERSDTSAETLGDDRQTGSTAEPAETDKDRAWREYLTASAAAPVVQRAVEVSYIDTAVETPVPHTTSLRKQAINRKRDFCPKHRAKPKLRVRKS

SEQ ID NO: 70 - protein, 213 aa, Neisseria
  VARIANT (1)...(213): Xaa = Any Amino Acid
MQARLLIPILFSVFILSACGTLTGIPSHGGXKRFAVEQELVAASARAAVKDMDLQALHGRKVALYIATMGDQGSGSLTGGRYSIDAXXXGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEM

SEQ ID NO: 71 - protein, 320 aa, Neisseria
MQARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIRPYGNHTGNSAPSVEADNSHEGYGYSDEVVRQHRQGQP

SEQ ID NO: 72 - protein, 320 aa, Neisseria
MQARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIQPYGNHMGNSAPSVEADNSHEGYGYSDEAVRRHRQGQP

SEQ ID NO: 73 - protein, 320 aa, Neisseria
MRARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSRSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIQPYGNHTGNSAPSVEADNSHEGYGYSDEAVRQHRQGQP

SEQ ID NO: 74 - protein, 196 aa, Neisseria
  VARIANT (1)...(196): Xaa = Any Amino Acid
GQHKKQAVNGKTVFTMMPGMIFGVFTGAFSAKYIPAFGLQIFFILFLTAVAFKTLHTDPQTASRPLPGLPXLTAVSTLFGTMSSWVGIGGGSLSVPFLIHCGFPAHKAIGTSSGLAWPIALSGAISYLLNGLNIAGLPEGSLGFLYLPAVAVLSAATIAFAPLGVKTAHKLSSAKLKKSFGIMLLLIAGKMLYNLL

SEQ ID NO: 75 - protein, 268 aa, Neisseria
  VARIANT (1)...(268): Xaa = Any Amino Acid
MWHWDIILILLAVGSAAGFIAGLFGVGGGTLIVPVVLWVLDLQGLAQHPYAQHLAVGTSFAVMVFTAFSSMLGQHKKQAVDWKTVFTMMPGMIFGVFTGALSAKYIPAFGLQIFFILFLTAVAFKTLHTDPQTASRPLPGLPGLTAVSTLFGTMSSWVGIGGGSLSVPFLIHCGFPAHKAIGTSSGLAWPIALSGAISYLLNGLNIAGLPEGSLGFLYLPAVAVLSAATIAFAPLGVKTAHKLSSAKLKKXFGIMLLLIAGKMLYNLL

SEQ ID NO: 76 - protein, 268 aa, Neisseria
MWHWDIILILLAVGSAAGFIAGLFGVGGGTLIVPVVLWVLDLQGLAQHPYAQHLAVGTSFAVMVFTAFSSMLGQHKKQAVDWKTVFTMMPGMVFGVFAGALSAKYIPAFGLQIFFILFLTAVAFKTLHTDPQTASRPLPGLPGLTAVSTLFGTMSSWVGIGGGSLSVPFLIHCGFPAHKAIGTSSGLAWPIALSGAISYLLNGLNIAGLPEGSLGFLYLPAVAVLSAATIAFAPLGVKTAHKLSSAKLKKSFGIMLLLIAGKMLYNLL

SEQ ID NO: 77 - protein, 268 aa, Neisseria
MWHWDIILILLAVGSAAGFIAGLFGVGGGTLIVPVVLWVLDLQGLAQHPYAQHLAVGTSFAVMVFTAFSSMLGQHKKQAVDWKTIFAMMPGMIFGVFAGALSAKYIPAFGLQIFFILFLTAVAFKTLHTGRQTASRPLPGLPGLTAVSTLFGAMSSWVGIGGGSLSVPFLIHCGFPAHKAIGTSSGLAWPIALSGAISYLVNGLNIAGLPEGSLGFLYLPAVAVLSAATIAFAPLGVKTAHKLSSAKLKESFGIMLLLIAGKMLYNLL

SEQ ID NO: 78 - protein, 268 aa, Neisseria; identical to SEQ ID NO: 77

SEQ ID NO: 79 - protein, 116 aa, Neisseria
GNGWQADPEHPLLGLFAVSNVSMTLAFVGICALVHYCFSGTVQVFVFAALLKLYALKPVYWFVLQFVLMAVAYVHRCGIDRQPPSTFGGSQLRLGGLTAALMQVSVLVLLLSEIGR

SEQ ID NO: 80 - protein, 201 aa, Neisseria
MILLHLDFLSALLYAAVFLFLIFRAGMLQWFWASIMLWLGISVLGAKLMPGIWGMTRAAPLFIPHFYLTLGSIFFFIGHWNRKTDGNGWQADPEHPLLGLFAVSNVSMTLAFVGICALVHYCFSGTVQVFVFAALLKLYALKPVYWFVLQFVLMAVAYVHRCGIDRQPPSTFGGSQLRLGGLTAALMQVSVLVLLLSEIGR

SEQ ID NO: 81 - protein, 201 aa, Neisseria
  VARIANT (1)...(201): Xaa = Any Amino Acid
MILLHLDFLSALLYAAVFLFLIFRAGMLQWFWASIMLWLGISVLGAKLMPGIWGMTRAAPLFIPHFYLTLGSIFFFIGHWNRKTDGNGWQADPEHPLLGLFAVSNVSMTLAFVGICALVHYCFSXTVQVFVFAALLKLYALKPVYWFVLQFVLMAVAYVHRCGIDRQPPSTFGGSQLRLGGLTAALMQXSVLVLLLSEIGR

SEQ ID NO: 82 - protein, 201 aa, Neisseria
MILLHLDFLSALLYAAVFLFLIFRAGMLQWFWASIALWLGISVLGVKLMPGMWGMTRAAPLFIPHFYLTLGSIFFFIGYWNRKTDGNGWQADPEHPLLGLFAVSNVSMTLAFVGICALVHYCFSGTVQVFVFAALLKLYALKPVYWFVLQFVLMAVAYVHRCGIDRQPPSTFGGSQLRLGVLAAMLMQVAVTAMLLAEIGR

SEQ ID NO: 83 - protein, 103 aa, Neisseria
  VARIANT (1)...(103): Xaa = Any Amino Acid
MKTPLLKPLLITSLPVFASVFTAASIVWQLGEPKLAMPFVLGIIAGGLVDLDNXXTGRLKNIITTVALFTLSSLTAQSTLGTGLPFILAMTLMTXXFTILGAX

SEQ ID NO: 84 - protein, 716 aa, Neisseria
MKTPLLKPLLITSLPVFASVFTAASIVWQLGEPKLAMPFVLGIIAGGLVDLDNRLTGRLKNIITTVALFTLSSLTAQSTLGTGLPFILAMTLMTFGFTILGAVGLKYRTFAFGALAVATYTTLTYTPETYWLTNPFMILCGTVLYSTAILLFQIVLPHRPVQESVANAYDALGGYLEAKADFFDPDEAAWIGNRHIDLAMSNTGVITAFNQCRSALFYRLRGKHRHPRTAKMLRYYFAAQDIHERISSAHVDYQEMSEKFKNTDIIFRIHRLLEMQGQACRNTAQALRASKDYVYSKRLGRAIEGCRQSLRLLSDSNDSPDIRHLRRLLDNLGSVDQQFRQLQHNGLQAENDRMGDTRIAALETSSLKNTWQAIRPQLNLESGVFRHAVRLSLVVAAACTIVEALNLNLGYWILLTALFVCQPNYTATKSRVRQRIAGTVLGVIVGSLVPYFTPSVETKLWIVIASTTLFFMTRTYKYSFSTFFITIQALTSLSLAGLDVYAAMPVRIIDTIIGASLAWAAVSYLWPDWKYLTLERTAALAVCSNGAYLEKITERLKSGETGDDVEYRATRRRAHEHTAALSSTLSDMSSEPAKFADSLQPGFTLLKTGYALTGYISALGAYRSEMHEECSPDFTAQFHLAAEHTAHIFQHLPETEPDDFQTALDTLRGELDTLRTHSSGTQSHILLQQLQLIARQLEPYYRAYRQIPHRQPQNAA

SEQ ID NO: 85 - protein, 716 aa, Neisseria
MKTPPLKPLLITSLPVFASVFTAASIVWQLGEPKLAMPFVLGIIAGGLVDLDNRLTGRLKNIIATVALFTLSSLVAQSTLGTGLPFILAMTLMTFGFTIMGAVGLKYRTFAFGALAVATYTTLTYTPETYWLTNPFMILCGTVLYSTAIILFQIILPHRPVQENVANAYEALGSYLEAKADFFDPDEAEWIGNRHIDLAMSNTGVITAFNQCRSALFYRLRGKHRHPRTAKMLRYYFAAQDIHERISSAHVDYQEMSEKFKNTDIIFRIHRLLEMQGQACRNTAQALRASKDYVYSKRLGRAIEGCRQSLRLLSDSNDNPDIRHLRRLLDNLGSVDQQFRQLQHNGLQAENDRMGDTRIAALETGSLKNTWQAIRPQLNLESGVFRHAVRLSLVVAAACTIVEALNLNLGYWILLTALFVCQPNYTATKSRVRQRIAGTVLGVIVGSLVPYFTPSVETKLWIVIASTTLFFMTRTYKYSFSTFFITIQALTSLSLAGLDVYAAMPVRIIDTIIGASLAWAAVSYLWPDWKYLTLERTAALAVCSNGAYLEKITERLKSGETGDDVEYRATRRRAHEHTAALSSTLSDMSSEPAKFADSLQPGFTLLKTGYALTGYISALGAYRSEMHEECSPDFTAQFHLAAEHTAHIFQHLPETEPDDFQTALDTLRGELDTLRTHSSGTQSHILLQQLQLIARQLEPYYRAYRQIPHRQPQNAA

SEQ ID NO: 86 - protein, 370 aa, Neisseria
MKTPLLKPLLITSLPVFASVFTAASIVWQLGEPKLAMPFVLGIIAGGLVDLDNRLTGRLKNIIATVALFTLSSLTAQSTLGTGLPFILAMTLMTFGFTILGAVGLKYRTFAFGALAVATYTTLTYTPETYWLTNPFMILCGTVLYSTAIILFQIILPHRPVQESVANAYEALGGYLEAKADFFDPDEAAWIGNRHIDLAMSNTGVITAFNQCRSALFYRLRGKHRHPRTAKMLRYYFAAQDIHERISSAHVDYQEMSEKFKNTDIIFRIRRLLEMQGQACRNTAQAIRSGKDYVYSKRLGRAIEGCRQSLRLLSDGNDSPDIRHLSRLLDNLGSVDQQFRQLRHSDSPAENDRMGDTRIAALETGSFKNT

SEQ ID NO: 87 - protein, 716 aa, Neisseria
MKTPLLKPLLITSLPVFASVFTAASIVWQLGEPKLAMPFVLGIIAGGLVDLDNRLTGRLKNIIATVALFTLSSLTAQSTLGTGLPFILAMTLMTFGFTILGAVGLKYRTFAFGALAVATYTTLTYTPETYWLTNPFMILCGTVLYSTAIILFQIILPHRPVQESVANAYEALGGYLEAKADFFDPDEAAWIGNRHIDLAMSNTGVITAFNQCRSALFYRLRGKHRHPRTAKMLRYYFAAQDIHERISSAHVDYQEMSEKFKNTDIIFRIRRLLEMQGQACRNTAQAIRSGKDYVYSKRLGRAIEGCRQSLRLLSDGNDSPDIRHLSRLLDNLGSVDQQFRQLRHSDSPAENDRMGDTRIAALETGSFKNTWQAIRPQLNLESCVFRHAVRLSLVVAAACTIVEALNLNLGYWILLTALFVCQPNYTATKSRVYQRIAGTVLGVIVGSLVPYFTPSVETKLWIVIAGTTLFFMTRTYKYSFSTFFITIQALTSLSLAGLDVYAAMPVRIIDTIIGASLAWAAVSYLWPDWKYLTLERTAALAVCSSGTYLQKIAERLKTGETGDDIEYRITRRRAHEHTAALSSTLSDMSSEPAKFADSLQPGFTLLKTGYALTGYISALGAYRSEMHEECSPDFTAQFHLAAEHTAHIFQHLPDMGPDDFQTALDTLRGELGTLRTRSSGTQSHILLQQLQLIARQLEPYYRAYRQIPHRQPQNAA

SEQ ID NO: 88 - protein, 454 aa, Neisseria
  VARIANT (1)...(454): Xaa = Any Amino Acid
MNMLGALAKVGSLTMVSRVLGFVRDTVIARAFGAGMATDAFFVAFKLPNLLRRVFAEGAFAQAFVPILAEYKETRSKEAXEAFIRHVAGMLSFVLVIVTALGILAAPWVIYVSAPSFAQDADKFQLSIDLLRITFPYILLISLSSFVGSVLNSYHKFGIPAFTPXFLNVSFIVFALFFVPYFDPPVTAXAWAVFVGGILQLXFQLPWLAKLGFLKLPKLSFKDAAVNRVMKQMAPAILGVSVAQVSLVINTIFASYLQSGSVSWMYYADRMMELPSGVLGAALGTILLPTLSKHSANQDTEQFSALLDWGLRLCMLLTLPAAVGLAVLSFPLVATLFMYRXFTLFDAQMTQHALIAYSFGLIGLIMIKVLAPGFYARQNIXXPVKIAIFTLICXQLMNLXFXGPLXXIGLSLAIGLGACINAGLLFYLLRRHGIYQPXQGLGSVLXQKCCSRSP

SEQ ID NO: 89 - protein, 512 aa, Neisseria
MNMLGALAKVGSLTMVSRVLGFVRDTVIARAFGAGMATDAFFVAFKLPNLLRRVFAEGAFAQAFVPILAEYKETRSKEAAEAFIRHVAGMLSFVLVIVTALGILAAPWVIYVSAPGFAQDADKFQLSIDLLRITFPYILLISLSSFVGSVLNSYHKFGIPAFTPTFLNVSFIVFALFFVPYFDPPVTALAWAVFVGGILQLGFQLPWLAKLGFLKLPKLSFKDAAVNRVMKQMAPAILGVSVAQVSLVINTIFASYLQSGSVSWMYYADRMMELPSGVLGAALGTILLPTLSKHSANQDTEQFSALLDWGLRLCMLLTLPAAVGLAVLSFPLVATLFMYREFTLFDAQMTQHALIAYSFGLIGLIMIKVLAPGFYARQNIKTPVKIAIFTLICTQLMNLAFIGPLKHVGLSLAIGLGACINAGLLFYLLRRHGIYQPGKGWAAFLAKMLLSLAVMCGGLWAAQAYLPFEWAHAGGMRKAGQLCILIAVGGGLYFASLAALGFRPRHFKRVEN

SEQ ID NO: 90 - protein, 512 aa, Neisseria
  VARIANT (1)...(512): Xaa = Any Amino Acid
MNMLGALVKVGSLTMVSRVLGFVRDTVIARAFGAGMATDAFFVAFKLPNLLRRVFAEGAFAQAFVPILAEYKETRSKEATEAFIRHVAGMLSFVLVIVTALGILAAPWVIYVSAPGFAKDADKFQLSIDLLRITFPYILLISLSSFVGSVLNSYHKFSIPAFTPTFLNVSFIVFALFFVPYFDPPVTALAWAVFVGGILQLGFQLPWLAKLGFLKLPKLSFKDAAVNRVMKQMAPAILGVSVAQISLVINTIFASYLQSGSVSWMYYADRMMELPGGVLGAALGTILLPTLSKHSANQDTEQFSALLDWGLRXCMLLTLPAAVGMAVLSFPLVATLFMYREFTLFDAQMTQHALIAYSFGLIGLIMIKVLAPGFYARQNIKTPVKIAIFTLICTQLMNLAFIGPLKHVGLSLAIGLGACINAGLLFYLLRRHGIYQPGKGWAAFLAKMLLSLAVMGGGLYAAQIWLPFDWAHAGGMQKAARLFILIAVGGGLYFASLAALGFRPRHFKRVES

SEQ ID NO: 91 - protein, 454 aa, Neisseria
MNMLGALAKVGSLTMVSRVLGFVRDTVIARAFGAGMATDAFFVAFKLPNLLRRVFAEGAFAQAFVPILAEYKETRSKEATEAFIRHVAGMLSFVLIVVTALGILAAPWVIYVSAPGFTKDADKFQLSISLLRITFPYILLISLSSFVGSILNSYHKFGIPAFTPTFLNISFIVFALFFVPYFDPPVTALAWAVFVGGILQLGFQLPWLAKLGFLKLPKLNFKDAAVNRVMKQMAPAILGVSVAQISLVINTIFASYLQSGSVSWMYYADRMMELPGGVLGAALGTILLPTLSKHSANQDTEQFSALLDWGLRLCMLLTLPAAAGLAVLSFPLVATLFMYREFTLFDAQMTQHALIAYSFGLIGLIMIKVLASGFYARQNIKTPVKIAIFTLICTQLMNLAFIGPLKHAGLSLAIGLGACINAGLLFFLFRKHGIYRPGQGLGQPSWRKCCSRSP

SEQ ID NO: 92 - protein, 512 aa, Neisseria
MNMLGALAKVGSLTMVSRVLGFVRDTVIARAFGAGMATDAFFVAFKLPNLLRRVFAEGAFAQAFVPILAEYKETRSKEATEAFIRHVAGMLSFVLIVVTALGILAAPWVIYVSAPGFTKDADKFQLSISLLRITFPYILLISLSSFVGSILNSYHKFGIPAFTPTFLNISFIVFALFFVPYFDPPVTALAWAVFVGGILQLGFQLPWLAKLGFLKLPKLNFKDAAVNRVMKQMAPAILGVSVAQISLVINTIFASYLQSGSVSWMYYADRMMELRRGVLGAALGTILLPTLSKHSANQDTEQFSALLDWGLRLCMLLTLPAAAGLAVLSFPLVATLFMYREFTLFDAQMTQHALIAYSFGLIGLIMIKVLASGFYARQNIKTPVKIAIFTLICTQLMNLAFIGPLKHAGLSLAIGLGACINAGLLFFLLRKHGIYRPGRGWAAFLAKMLLALAVMCGGLWAAQACLPFEWAHAGGMRKAGQLCILIAVGGGLYFASLAALGFRPRHFKRVES

SEQ ID NO: 93 - protein, 158 aa, Neisseria
  VARIANT (1)...(158): Xaa = Any Amino Acid
MIKIKKGLNLPIAGRPEQAVYDGPAITEVALLGEEYAGMRPSMKVKEGDAVKKGQVLFEDKKNPGVVFTAPASGKIAAIHRGEKRVLQSVVIAVEXNDEIEFERYAPEALANLSGEEVRRNLIQSGLWTALRTRPFSKIPAVDAEPFAIFVNAMDTNP

SEQ ID NO: 94 - protein, 447 aa, Neisseria
MIKIKKGLNLPIAGRPEQAVYDGPAITEVALLGEEYAGMRPSMKVKEGDAVKKGQVLFEDKKNPGVVFTAPASGKIAAIHRGEKRVLQSVVIAVEGNDEIEFERYAPEALANLSGEEVRRNLIQSGLWTALRTRPFSKIPAVDAEPFAIFVNAMDTNPLAADPTVIIKEAAEDFKRGLLVLSRLTERKIHVCKAAGADVPSENAANIETHEFGGPHPAGLSGTHIHFIEPVGANKTVWTINYQDVITIGRLFATGRLNTERVIALGGSQVNKPRLLRTVLGAKVSQITAGELVDTDNRVISGSVLNGAITQGAHDYLGRYHNQISVIEEGRSKELFGWVAPQPDKYSITRTTLGHFLKNKLFKFNTAVNGGDRAMVPIGTYERVMPLDILPTLLLRDLIVGDTDSAQALGCLELDEEDLALCSFVCPGKYEYGPLLRKVLETIEKEG

SEQ ID NO: 95 - protein, 447 aa, Neisseria
  VARIANT (1)...(447): Xaa = Any Amino Acid
MIKIKKGLNLPIAGRPEQVIYDGPVITEVALLGEEYAGMRPXMKVKEGDAVKKGQVLFEDKKXPGVVFTAPVSGKIAAIHRGEKRVLQSVVIAVEGNDEIEFERYAPEALANLSGXEXXXNLIQSGLWTALRXRPFSKIPAVDAEPFAIFVNAMDTNPLAADPVVVIKEAXXDFRRXXLVLSRLTERKIHVCKAAGADVPSENAANIETHEFGGPHPAGLSGTHIHFIEPVGANKTVWTINYQDVIAIGRLFATGRLNTERVIALGGSQVNKPRLLRTVLGAKVSQITAGELVDADNRVISGSVLNGAITQGAHDYLGRYHNQISVIEEGRSKELFGWVAPQPDKYSITRTTLGHFLKNKLFKFTTAVNGGDRAMVPIGTYERVMPLDILPTLLLRDLIVGDTDSAQALGCLELDEEDLALCSFVCPGKYEXGPLLRKVLETXEKEG

SEQ ID NO: 96 - protein, 322 aa, Neisseria
MIKIKKGLNLPIAGRPEQVIYDGPAITEVALLGEEYVGMRPSMKIKEGEAVKKGQVLFEDKKNPGVVFTAPASGKIAAIHRGEKRVLQSVVIAVEGNDEIEFERYVPEALAKLSSEKVRRNLIQSGLWTALRTRPFSKIPAVDAEPFAIFVNAMDTNPLAADPTVIIKEAAEDFKRGLLVLSRLTERKIHVCKAAGADVPSENAANIETHEFGGPHPAGLSGTHIHFIEPVGANKTVWTINYQDVIAIGRLFVTGRLNTERVVALGGLQVNKPRLLRTVLGAKVSQLTAGELVDADNRVISGSVLNGAIAQGAHDYLGRYHN

SEQ ID NO: 97 - protein, 447 aa, Neisseria
MIKIKKGLNLPIAGRPEQVIYDGPAITEVALLGEEYVGMRPSMKIKEGEAVKKGQVLFEDKKNPGVVFTAPASGKIAAIHRGEKRVLQSVVIAVEGNDEIEFERYVPEALAKLSSEKVRRNLIQSGLWTALRTRPFSKIPAVDAEPFAIFVNAMDTNPLAADPTVIIKEAAEDFKRGLLVLSRLTERKIHVCKAAGADVPSENAANIETHEFGGPHPAGLSGTHIHFIEPVGANKTVWTINYQDVIAIGRLFVTGRLNTERVVALGGLQVNKPRLLRTVLGAKVSQLTAGELVDADNRVISGSVLNGAIAQGAHDYLGRYHNQISVIEEGRSKELFGWVAPQPDKYSITRTTLGHFLKNKLFKFTTAVNGGDRAMVPIGTYERVMPLDILPTLLLRDLIVGDTDSAQALGCLELDEEDLALCSFVCPGKYEYGPLLRKVLETIEKEG

SEQ ID NO: 98 - protein, 320 aa, Neisseria
  VARIANT (1)...(320): Xaa = Any Amino Acid
AXXIIHPXXVVGPEANWFFMVASTFVIALIGYFVTEKIVEPQLGPYQSDLSQEEKDIRHSNEITPLEYKGLIWAGVVFVALSALLAWSIVPADGILRHPETGLVSGSPFLKSIVVFIFLLFALPGIVYGRVTRSLRGEQEVVNAXAESMSTLXLXLXXIFFAAQFVAFFNWTNIGQYIAVKGATFLKEVGLGGSVLFIGFILICAFINLMIGSASAQWAVTAPIFVPMLMLAGYAPEVIQAAYRIGDSVTNIITPMMSYFGLIMATVXXYKKDAGVGTLIXMMLPYSAFFLIAWIALFCIWVFVLGLPVGPGAPTFYPAP

SEQ ID NO: 99 - protein, 522 aa, Neisseria
MSQTDTQRDGRFLRTVEWLGNMLPHPVTLFIIFIVLLLIASAVGAYFGLSVPDPRPVGAKGRADDGLIYIVSLLNADGFIKILTHTVKNFTGFAPLGTVLVSLLGVGIAEKSGLISALMRLLLTKSPRKLTTFMVVFTGILSNTASELGYVVLIPLSAIIFHSLGRHPLAGLAAAFAGVSGGYSANLFLGTIDPLLAGITQQAAQIIHPDYVVGPEANWFFMVASTFVIALIGYFVTEKIVEPQLGPYQSDLSQEEKDIRHSNEITPLEYKGLIWAGVVFVALSALLAWSIVPADGILRHPETGLVSGSPFLKSIVVFIFLLFALPGIVYGRVTRSLRGEQEVVNAMAESMSTLGLYLVIIFFAAQFVAFFNWTNIGQYIAVKGATFLKEVGLGGSVLFIGFILICAFINLMIGSASAQWAVTAPIFVPMLMLAGYAPEVIQAAYRIGDSVTNIITPMMSYFGLIMATVIKYKKDAGVGTLISMMLPYSAFFLIAWIALFCIWVFVLGLPVGPGAPTFYPAP

SEQ ID NO: 100 - protein, 522 aa, Neisseria
MSQTDTQRDGRFLRTVEWLGNMLPHPVTLFIIFIVLLLIASAAGAYFGLSVPDPRPVGAKGRADDGLIHVVSLLDADGLIKILTHTVKNFTGFAPLGTVLVSLLGVGIAEKSGLISALMRLLLTKSPRKLTTFMVVFTGILSNTASELGYVVLIPLSAIIFHSLGRHPLAGLAAAFAGVSGGYSANLFLGTIDPLLAGITQQAAQIIHPDYVVGPEANWFFMVASTFVIALIGYFVTEKIVEPQLGPYQSDLSQEEKDIRHSNEITPLEYKGLIWAGVVFVALSALLAWSIVPADGILRHPETGLVSGSPFLKSIVVFIFLLFALPGIVYGRVTRSLRGEQEVVNAMAESMSTLGLYLVIIFFAAQFVAFFNWTNIGQYIAVKGATFLKEVGLGGSVLFIGFILICAFINLMIGSASAQWAVTAPIFVPMLMLAGYAPEVIQAAYRIGDSVTNIITPMMSYFGLIMATVIKYKKDAGVGTLISMMLPYSAFFLIAWIALFCIWVFVLGLPVGPGAPTFYPAP

SEQ ID NO: 101 - protein, 522 aa, Neisseria
MSQTDARRSGRFLRTVEWLGNMLPHPVTLFIIFIVLLLIASAVGAYFGLSVPDPRPVGAKGRADDGLIHVVSLLDADGLIKILTHTVKNFTGFAPLGTVLVSLLGVGIAEKSGLISALMRLLLTKSPRKLTTFMVVFTGILSNTASELGYVVLIPLSAVIFHSLGRHPLAGLAAAFAGVSGGYSANLFLGTIDPLLAGITQQAAQIIHPDYVVGPEANWFFMAASTFVIALIGYFVTEKIVEPQLGPYQSDLSQEEKDIRHSNEITPLEYKGLIWAGVVFVALSALLAWSIVPADGILRHPETGLVAGSPFLKSIVVFIFLLFALPGIVYGRITRSLRGEREVVNAMAESMSTLGLYLVIIFFAAQFVAFFNWTNIGQYIAVKGAVFLKKFRLGGSVLFIGFILICAFINLMIGSASAQWAVTAPIFVPMLMLAGNAPQVIQAAYRIGDSVTNIITPMMSYFGLIMATVIKYKKDAGVGTLISMMLPYSAFFLIAWIALFCIWVFVLGLPVGPGTPTFYPVP

SEQ ID NO: 102 - protein, 167 aa, Neisseria
  VARIANT (1)...(167): Xaa = Any Amino Acid
TAGAAGXXVFVFVTDSQVEVFGNIQTAVETGFFHGISVSSVFGAAAQDSAMASRSASIPVFSATEMRTAAIFPAASRHMPVFCSSDGSRSVLLYTLMHGISPAWISCSTFSTSSICCPLFGAAASTTCSSTSACAVSSSVAEKAEISLCGRXLTNPTVSVRIMLHSG

SEQ ID NO: 103 - protein, 381 aa, Neisseria
MEDLQEIGFDVAAVKVGRQREHHRLHHPQPGNGEADDVLFAFFLVGGFDFLRVIGCGGVAYLPDFQQNVGKADFAVVPDDAAAVRAVIEVDADDAVCTQKLLFDQPDAGGAGDAAEHNRLARAAVGFHKVGLDFGQVVQADLVEDFLGRQLGFLRVGGALFVITAQARVNNALCDCLTTGAAGFAVFVFVTDGQMQVFGNVQPAVETGFFHGISVSSVFGAAAQYSAMASRSASIPVFSATEMRTAAIFPAASRHMPVFCSSDGSRSVLLYTLMHGISPAWISCSTFSTSSICCPLFGAAASTTCSSTSACAVSSSVAEKAEISLCGRSLTNPTVSVRIMLHSGLMYSRRAVVSSVAKSWSFAYMPDLVSRLNRLDLPTLV

SEQ ID NO: 104 - protein, 382 aa, Neisseria
MEDLQEIGFDVAAVKVGRQREHHRLHHTQSGNGKADDVLFAFFLVGGFDFLRVIGCGGVACLPDFQQNVGEADFAVVPDDAAAVRAVIEVDADDAVCAQKLLFDQPDAGGAGNAAEHQHCFVRAIMGFHKVGLDFGQVVQADLVEDFLGRQFGFFRVGGASFVITAQAGIDDALCDCLTADAAGFAVFAFVADGQMQVFGNVQPAVETGFFHGISVSSVFGAAAQYSAMASRSASIPVFSATEMRTAAIFPAASRHMPVFCSSDGSRSVLLYTLMHGISWAWISCSTFSTSSICCPLFRAAASTTCSSTSACTVSSKVAEKAEISLCGRSLTNPTVSVRIMLHAGLMYSRRAVVSRVAKSWSFAYMPDLVSRLNRLDLPTLV

SEQ ID NO: 105 - protein, 181 aa, Neisseria
  VARIANT (1)...(181): Xaa = Any Amino Acid
GHYSDRTWKPRLXGRRLPYLLYGTLIAVIVMILMPNSGSFGFGYASLAALSFGALMIALLDVSSNMAMQPFKMMVGDMVNEEQKXYAYGIQSFLANTGAVVAAILPFVFAYIGLANTAXKGVVPQTVVVAFYVGAALLVITSAFTIFKVKEYXPETYARYHGIDVAANQEKANWIALLKXA

SEQ ID NO: 106 - protein, 451 aa, Neisseria
MSEYTPQTAKQGLPALAKSTIWMLSFGFLGVQTAFTLQSSQMSRIFQTLGADPHNLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYDPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 107 - protein, 451 aa, Neisseria
MSEYTPQTAKQGLPALAKSTIWMLSFGFLGVQTAFTLQSSQMSRIFQTLGADPHSLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYNPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 108 - protein, 339 aa, Neisseria
MIGDRRAGNHFGFSKANTFQIKKKDLLYVGIYASNSKTRFARAGKKHDLDVELRLSRRSDGLYPAKLADEPHFSNARRRPAQFGLVFHPAAAGGDAGSADSGYYSDRTWKPRLGGRRLPYLLYGTLIAVIVMILMPNSGSFGFGYASLAALSFGALMIALLDVSSNMAMQPFKMMVGDMVNEEQKSYAYGIQSFLANTDAVVAAILPFVFAYIGLANTAEKGVVPQTVVVAFYVGAALLIITSAFTISKVKEYDPETYARYHGIDVAANQEKANWFELLKTAPKVFWTVTPVQFFCWFAFRYMWTYSAGAIAENVWHTTDASSVGHQEAGNRYGVLAAV

SEQ ID NO: 109 - protein, 120 aa, Neisseria
  VARIANT (1)...(120): Xaa = Any Amino Acid
MLFRKTTAAVLAHTLMLNGCTLMLWGMNNPVSETITRKHVXKDQIRXFGVVAEDNAQLEKGSLVMMGGKYWFVVNPEDSAXXTGILXAGLDKPFQIVXDTPSYXCHQALPVKLGSXGSQN

SEQ ID NO: 110 - protein, 238 aa, Neisseria
MLFRKTTAAVLAATLMLNGCTLMLWGMNNPVSETITRKHVDKDQIRAFGVVAEDNAQLEKGSLVMMGGKYWFVVNPEDSAKLTGILKAGLDKPFQIVEDTPSYARHQALPVKLESPGSQNFSTEGLCLRYDTDKPADIAKLKQLGFEAVKLDNRTIYTRCVSAKGKYYATPQKLNADYHFEQSVPADIYYTVTEEHTDKSKLFANILYTPPFLILDAAGAVLALPAAALGAVVDAARK

SEQ ID NO: 111 - protein, 237 aa, Neisseria
MLFRKTTAAVLAATLMLNGCTVMMWGMNSPFSETTARKHVDKDQIRAFGVVAEDNAQLEKGSLVMMGGKYWFVVNPEDSAKLTGILKAGLDKQFQMVEPNPRFAYQALPVKLESPASQNFSTEGLCLRYDTDRPADIAKLKQLEFEAVELDNRTIYTRCVSAKGKYYATPQKLNADYHFEQSVPADIYYTVTKKHTDKSKLFENIAYTPTTLILDAVGAVLALPVAALIAATNSSDK

SEQ ID NO: 112 - protein, 237 aa, Neisseria
MLFRKTTAAVLAATLILNGCTMMLRGMNNPVSQTITRKHVDKDQIRAFGVVAEDNAQLEKGSLVMMGGKYWFAVNPEDSAKLTGLLKAGLDKPFQIVEDTPSYARHQALPVKFEAPGSQNFSTGGLCLRYDTGRPDDIAKLKQLEFKAVKLDNRTIYTRCVSAKGKYYATPQKLNADYHFEQSVPADIYYTVTEKHTDKSKLFGNILYTPPLLILDAAAAVLVLPMALIAAANSSDK

SEQ ID NO: 113 - protein, 125 aa, Neisseria
  VARIANT (1)...(125): Xaa = Any Amino Acid
VSPVLPITHERTGFEGVIGYETHFSGHGHEVHSPFDHHDSKSTSDFSGGVDGGFTVYQLHRTWSEIHPEDEYDGPQAAXYPPPGGARDIYSYYVKGTSTKTKTSIVPQAPFSDRWLEENAGAASG

SEQ ID NO: 114 - protein, 483 aa, Neisseria
MNLPIQKFMMLFAAAISLLQIPISHANGLDARLRDDMQAKHYEPGGKYHLFGNARGSVKKRVYAVQTFDATAVSPVLPITHERTGFEGVIGYETHFSGHGHEVHSPFDHHDSKSTSDFSGGVDGGFTVYQLHRTGSEIHPEDGYDGPQGSDYPPPGGARDIYSYYVKGTSTKTKTNIVPQAPFSDRWLKENAGAASGFFSRADEAGKLIWESDPNKNWWANRMDDVRGIVQGAVNPFLMGFQGVGIGAITDSAVSPVTDTAAQQTLQGINDLGKLSPEAQLAAASLLQDSAFAVKDGINSAKQWADAHPNITATAQTALSAAEAAGTVWRGKKVELNPTKWDWVKNTGYKKPAARHMQTLDGEMAGGNKPIKSLPNSAAEKRKQNFEKFNSNWSSASFDSVHKTLTPNAPGILSPDKVKTRYTSLDGKITIIKDNENNYFRIHDNSRKQYLDSNGNAVKTGNLQGKQAKDYLQQQTHIRNLDK

SEQ ID NO: 115 - protein, 482 aa, Neisseria
  VARIANT (1)...(482): Xaa = Any Amino Acid
MNXPIQKFMMLFAAAISXLQIPISHANGLDARLRDDMQAKHYEPGGKYHLFGNARGSVKNRVYAVQTFDATAVGPILPITHERTGFEGIIGYETHFSGHGHEVHSPFDNHDSKSTSDFSGGVDGGFTVYQLHRTGSEIHPEDGYDGPQGSDYPPPGGARDIYXXYVKGTSTKTKSNIVPRAPFSDRWLKENAGAASGFFSRADEAGKLIWESDPNKNWWANRMDDIRGIVQGAVNPFLMGFQGVGIGAITDSAVSPVTDTAAQQTLQGXNHLGXLSPEAQLAAATALQDSAFAVKDGINSARQWADAHPNITATAQTALAVAXAATTVWGGKKVELNPTKWDWVKNTGYXTPAVRTMHTLDGEMAGGNRPPKSITSNSKADASTQPSLQAQLIGEQIXXGHAYNKHVIRQQEFTDLNINSPADFARHIENIVSHPXNMKELPRGRTAYWDXKTGTIVIRDKNSDDGGTAFRPTSGKKYYDDL

SEQ ID NO: 116 - protein, 468 aa, Neisseria
MNLPIQKFMMLFAAAISLLQIPISHANGLDARLRDDMQAKHYEPGGKYHLFGNARGSVKNRVCAVQTFDATAVGPILPITHERTGFEGVIGYETHFSGHGHEVHSPFDNHDSKSTSDFSGGVDGGFTVYQLHRTGSEIHPEDGYDGPQGGGYPPPGGARDIYSYHIKGTSTKTKINTVPQAPFSDRWLKENAGAASGFLSRADEAGKLIWENDPDKNWRANRMDDIRGIVQGAVNPFLTGFQGLGVGAITDSAVSPVTYAAARKTLQGIHNLGNLSPEAQLAAATALQDSAFAVKDSINSARQWADAHPNITATAQTALAVTEAATTVWGGKKVELNPAKWDWVKNTGYKKPAARHMQTVDGEMAGGNKPLESKNTVTTNNFFENTGYTEKVLRQASNGDYHGFPQSVDAFSENGTVIQIVGGDNIVRHKLYIPGSYKGKDGNFEYIREADGKINHRLFVPNQQLPEK

SEQ ID NO: 117 - protein, 498 aa, Neisseria
MNLPIQKFMMLLAAAISMLHIPISHANGLDARLRDDMQAKHYEPGGKYHLFGNARGSVKNRVCAVQTFDATAVGPILPITHERTGFEGVIGYETHFSGHGHEVHSPFDNHDSKSTSDFSGGVDGGFTVYQLHRTGSEIHPADGYDGPQGGGYPEPQGARDIYSYHIKGTSTKTKINTVPQAPFSDRWLKENAGAASGFLSRADEAGKLIWENDPDKNWRANRMDDIRGIVQGAVNPFLTGFQGVGIGAITDSAVSPVTDTAAQQTLQGINDLGNLSPEAQLAAASLLQDSAFAVKDGINSARQWADAHPNITATAQTALAVAEAAGTVWRGKKVELNPTKWDWVKNTGYKKPAARHMQTVDGEMAGGNRPPKSITSEGKANAATYPKLVNQLNEQNLNNIAAQDPRLSLAIHEGKKNFPIGTATYEEADRLGKIWVGEGARQTSGGGWLSRDGTRQYRPPTEKKSQFATTGIQANFETYTIDSNEKRNKIKNGHLNIR

SEQ ID NO: 118 - protein, 42 aa, Neisseria
MKKQITAAVMMLSMIAPAMANGLDNQAFEDQMFHTRADAPMQ

SEQ ID NO: 119 - protein, 181 aa, Neisseria
MKKQITAAVMMLSMIAPAMANGLDNQAFEDQVFHTRADAPMQLAELSQKEMKETEGAFLPLAILGGAAIGMWTQHGFSYATTGRPASVRDVAIAGGLGAIPGGVGAAGKVVSFAKYGREIKIGNNMRIAPFGNRTGHPIGKFPHYHRRVTDNTGKTLPGQGIGRHRPWESKSTDRSWKNRF

SEQ ID NO: 120 - protein, 181 aa, Neisseria
  VARIANT (1)...(181): Xaa = Any Amino Acid
MKKQITAAVMMLSMIAPAMANGLDNQAFEDQVFHTRADAPMQLAELSQKEMKXTXGAFLPLXILGGAAIGMWTQHGFSYATTGRPASVRDVAIAGGLGAIPGXVGAAGKVVSFAKYGREIKIGNNMRIAPFGNRTGHPIGKFPHYHRRVTDNTGKTLPGQGIGRHRPWESKSTDRSWKNRF

SEQ ID NO: 121 - protein, 179 aa, Neisseria
MKKQITAAVMMLSMIAPAMANGLDNQAFEDQVFHTRADAPMQLAELSQKEMKETEGAFLPLAILGGAAIGMWTQHGFSYATTGRPASVRDVAGGLGAIPGDVGAAGKVVSFAKYGREIKIGNNMRIAPFGNRTGHPIGKFPHYHRRVTDNTGKTLPGQGIGRHRPWESKSTDRSWKNRF

SEQ ID NO: 122 - protein, 84 aa, Neisseria
  VARIANT (1)...(84): Xaa = Any Amino Acid
MNKTLYRVIFNRKRGAVXAVAETTKREGKSCADSDSGSAHVKSVPFGTTHAPVCXVTNIFSFSLLGFSLCLAVGTXNIAFADGI

SEQ ID NO: 123 - protein, 83 aa, Neisseria
MNKTLYRVIFNRKRGAVVAVAETTKREGKSCADSDSGSAHVKSVPFGTTHAPVCRSNIFSFSLLGFSLCLAVGTANIAFADGI

SEQ ID NO: 124 - protein, 263 aa, Neisseria
MNKTLYRVIFNRKRGAVVAVAETTKREGKSCADSGSGSVYVKSVSFIPTHSKAFCFSALGFSLCLALGTVNIAFADGIITDKAAPKTQQATILQTGNGIPQVNIQTPTSAGVSVNQYAQFDVGNRGAILNNSRSNTQTQLGGWIQGNPWLTRGEARVVVNQINSSHPSQLNGYIEVGGRRAEVVIANPAGIAVNGGGFINASRATLTTGQPQYQAGDFSGFKIRQGNAVIAGHGLDARDTDFTRILVCQQNHLDQYGRTSRHS

SEQ ID NO: 125 - protein, 81 aa, Neisseria
MNTPPFVCWIFCKVIDNFGDIGVSWRLARVLHRELGWQVHLWTDDVSALRALCPDLPDVPCVHQDIHVRTWHSDAADIDTA

SEQ ID NO: 126 - protein, 382 aa, Neisseria
MNTPPFVCWIFCKVIDNFGDIGVSWRLARVLHRELGWQVHLWTDDVSALRALCPDLPDVPCVHQDIHVRTWHSDAADIDTAPVPDVVIETFACDLPENVLHIIRRHKPLWLNWEYLSAEESNERLHLMPSPQEGVQKYFWFMGFSEKSGGLIRERDYCEAVRFDTEALRERLMLPEKNASEWLLFGYRSDVWAKWLEMWRQAGSPMTLLLAGTQIIDSLKQSGVIPQDALQNDGDVFQTASVRLVKIPFVPQQDFDQLLHLADCAVIRGEDSFVRAQLAGKPFFWHIYPQDENVHLDKLHAFWDKAHGFYTPETVSAHRRLSDDLNGGEALSATQRLECWQTLQQHQNGWRQGAEDWSRYLFGQPSAPEKLAAFVSKHQKIR

SEQ ID NO: 127 - protein, 382 aa, Neisseria
  VARIANT (1)...(382): Xaa = Any Amino Acid
MNTPPFSAGXFCKVIDNFGDIGVSWRLARVLHRELGWQVHLWTDDVSALRALCPDLPDVXCVHQDIHVRTWHSDAADIDTAPVXDVVIETFACDLPENVLHIIRRHKPLWLXWEYLSAEXSNERLHXMPSPQESVXKXFWFMGFSEXSGGLIRERDYCEAVRFDSGALRKRLMLPEKNXPEWLLFGYRSDVWAKWLEMWRQAGSPLTLLLAGAXIIDSLKQNGVIPQDALQNDGDVFQTASVRLVKIPFVPQQDFDKLLHLADCAVIRGEDSFVRAQLAGKPFFWHIYPQDENVHLDKLHAFWDKAHGFYTPETASAHRRLSDDLNGGEALSATQRLECWQILQQHQNGWRQGAEDWSRYLFGQPSASEKLAAFVSKHQKIR

SEQ ID NO: 128 - protein, 345 aa, Neisseria
MVMNTYAFPVCWIFCKVIDNFGDIGVSWRLARVLHRELGWQVHLWTDDVSALRALCPDLPDVPFVHQDIHVRTWHSDAADIDTAPVPDAVIETFACDLPENVLNIIRRHKPLWLNWEYLSAEESNERLHLMPSPQEGVQKYFWFMGFSEKSGGLIRERDYREAVRFDTEALRRRLVLPEKNAPEWLLFGYRGDVWAKWLDMWQQAGSLMTLLLAGAQIIDSLKQSGVIPQNALQNEGGVFQTASVRLVKIPFVPQQDFDKLLHLADCAVIRGEDSFVRTQLAGKPFFWHIYPQDENVHLDKLHAFWDKAYGFYTPETASVHRLLSDDLNGGEALSATQRLECGVL

SEQ ID NO: 129 - protein, 383 aa, Neisseria
MNTYAFPVCWIFCKVIDNFGDIGVSWRLARVLHRELGWQVHLWTDDVSALRALCPDLPDVPFVHQDIHVRTWHSDAADIDTAPVPDAVIETFACDLPENVLNIIRRHKPLWLNWEYLSAEESNERLHLMPSPQEGVQKYFWFMGFSEKSGGLIRERDYREAVRFDTEALRRRLVLPEKNAPEWLLFGYRGDVWAKWLDMWQQAGSLMTLLLAGAQIIDSLKQSGVIPQNALQNEGGVFQTASVRLVKIPFVPQQDFDKLLHLADCAVIRGEDSFVRTQLAGKPFFWHIYPQDENVHLDKLHAFWDKAYGFYTPETASVHRLLSDDLNGGEALSATQRLECWQTLQQHQNGWRQGAEDWSRYLFGQPSASEKLAAFVSKHQKIR

SEQ ID NO: 130 - protein, 143 aa, Neisseria
  VARIANT (1)...(143): Xaa = Any Amino Acid
LFLRVKVGRFFSSPATWFRXKDPVNQAVLRLYXDEWRXTSVRWKIXATSHSLWLCTLLGMLVSVLLLLLVRQYTFNWESTLLSNAASVRAVEMLAWLPSKLGFPVPDARSVIEGRLNGNIADARAWSGLLVXSIACXGILPRL

SEQ ID NO: 131 - protein, 446 aa, Neisseria
MLNPSRKLVELVRILDEGGFIFSGDPVQATEALRRVDGSTEEKIIRRAEMIDRNRMLRETLERVRAGSFWLWVVAATFAFFTGFSVTYLLMDNQGLNFFLVLAGVLGMNTLMLAVWLAMLFLRVKVGRFFSSPATWFRGKDPVNQAVLRLYADEWRQPSVRWKIGATSHSLWLCTLLGMLVSVLLLLLVRQYTFNWESTLLSNAASVRAVEMLAWLPSKLGFPVPDARAVIEGRLNGNIADARAWSGLLVGSIACYGILPRLLAWVVCKILLKTSENGLDLEKPYYQAVIRRWQNKITDADTRRETVSAVSPKIILNDAPKWAVMLETEWQDGEWFEGRLAQEWLDKGVATNREQVAALETELKQKPAQLLIGVRAQTVPDRGVLRQIVRLSEAAQGGAVVQLLAEQGLSDDLSEKLEHWRNALAECGAAWLEPDRAAQEGRLKDQ

SEQ ID NO: 132 - protein, 449 aa, Neisseria
  VARIANT (1)...(449): Xaa = Any Amino Acid
MLNPSRKLVELVRILEEGGFIFSGDPVQATEALRRVDGSTEEKIIRRAKMIDRNRMLRETLERVRAGSFWLWVAAATFAFXTXFSVTYLLMDNQGLNFFLVLAGVXGMNTLMLAVWLAMLFLRVKVGRFFSSPATWFRGKDPVNQAVLRLYADEWRXPSVRWKIGATSHSLWLCTLLGMLVSVLLLLLVRQYTFNWESTLLGDSSSVRLVEMLAWLPAKLGFPVPDARAVIEGRLNGNIADARAWSGLLVGSIACYGILPRLLAWAVCKILXXTSENGLDLEKXXXXXXIRRWQNKITDADTRRETVSAVSPKIVLNDAPKWAVMLETEWQDGEWFEGRLAQEWLDKGVAANREQVAALETELKQKPAQLLIGVRAQTVPDRGVLRQIVRLSEAAQGGAVVXLLAEQGLSDDLSEKLEHWRNALTECGAAWLEPDRAAQEGRLKTNDRT

SEQ ID NO: 133 - protein, 397 aa, Neisseria
MIDRDRMLRDTLERVRAGSFWLWVVVASMMFTAGFSGTYLLMDNQGLNFFLVLAGVLGMNTLMLAVWLATLFLRVKVGRFFSSPATWFRGKGPVNQAVLRLYADQWRQPSVRWKIGATAHSLWLCTLLGMLVSVLLLLLVRQYTFNWESTLLSNAASVRAVEMLAWLPSKLGFPVPDARAVIEGRLNGNIADARAWSGLLVGSIVCYGILPRLLAWVVCKILLKTSENGLDLEKTYYQAVIRRWQNKITDADTRRETVSAVSPKIVLNDAPKWALMLETEWQDGQWFEGRLAQEWLDKGVAANREQVAALETELKQKPAQLLIGVRAQTVPDRGVLRQIVRLSEAAQGGAVVQLLAEQGLSDDLSEKLEHWRNALTECGAAWLEPDRVAQEGRLKDQ

SEQ ID NO: 134 - protein, 446 aa, Neisseria
MLNPSRKLVELVRILNKGGFIFSGDPVQATEALRRVDGSTEEKIFRRAEMIDRDRMLRDTLERVRAGSFWLWVVVASMMFTAGFSGTYLLMDNQGLNFFLVLAGVLGMNTLMLAVWLATLFLRVKVGRFFSSPATWFRGKGPVNQAVLRLYADQWRQPSVRWKIGATAHSLWLCTLLGMLVSVLLLLLVRQYTFNWESTLLSNAASVRAVEMLAWLPSKLGFPVPDARAVIEGRLNGNIADARAWSGLLVGSIVCYGILPRLLAWVVCKILLKTSENGLDLEKTYYQAVIRRWQNKITDADTRRETVSAVSPKIVLNDAPKWALMLETEWQDGQWFEGRLAQEWLDKGVAANREQVAALETELKQKPAQLLIGVRAQTVPDRGVLRQIVRLSEAAQGGAVVQLLAEQGLSDDLSEKLEHWRNALTECGAAWLEPDRVAQEGRLKDQ

SEQ ID NO: 135 - protein, 150 aa, Neisseria
  VARIANT (1)...(150): Xaa = Any Amino Acid
QKSLSRISLWGLGGVFFGVSGLVWFSLGVSXECACFSGVSFRGSGRGTFVGSTGVSLSVFSACVXGVVRLPVGLSCVGRLXXLTRFFLGAAGDVILLPLSSVPSGCAGSDEAAWWCSGWAASCPTTPFGSQNSVSRGLSVCCGSARVLSS

SEQ ID NO: 136 - protein, 453 aa, Neisseria
  VARIANT (1)...(453): Xaa = Any Amino Acid
MMMPFIMLPWIAGVPAVPGQNRLSRISLWGLGGVFFGVSGLVWFSLGVSLGCACFSGVSFRGSGRGTFVGSTGVSLSVFSACVPASSGCLSVXAVSAGCGLTRFFLGAAGDGSPLPLSSVPSGCAGSDEAAWWCSGWAASCPTTPFGSQNSVSRGLSVCCGSAXRVLSPFGLNVLTMPIANAPMAAIQMSNTARIRSLGVSLKGLFGFFAILIVLLGCRAMPSEGGSDGIAESALDVVLVEGDDFLYADGGADFLGNLRLFFGGEDAHNVGYVAVGNDFDARLCGGADAQQRGADFGCVPSVAGDVAGSARQGGDGNIVVHAFGGLFGTCNLTDELFFAFGGDLSEQQQVAVVADDGDLGRVAFGLVVLAQIGTGGGFDTQRHNVVVGLRAGGSAVDGGFRADGGASDYCADAAAKGKAENGGNQGADGVRFGFHRVLPFLGVSDGIALRHAV

SEQ ID NO: 137 - protein, 459 aa, Neisseria
  VARIANT (1)...(459): Xaa = Any Amino Acid
MMXPXIMLPWIAGVPAVPGQKRLSRXSLWGLGGXFFGVSGLVWFSLGVSXSLGVSXGCACFSGVSFRGSGRGTFVGSTGVSLSVFSACAPASSGCLSVXAVSAGCGLTRXFXGAAGDGSPLPLSSVPSGCAGADEEAXXCSGWAASCPTTPFGSQNSVSRGLSVCCGSVWRVLSPFGXNVLTMPIANAPMAVIQMSNTARIRSLGVSLKGLFXFFAILIVLLGCRAMPSEGGSDGIAESALDVVXVEGDDFLYADGGADFLGNLRLFFGGEDAHNVGYVAVGNDFDARLCGGADAQQRGADFGCVPSVAGDVAGSARQGGDGNVXVHAFGGLFGTCNLTDELFLAFGGDLSEQQQVAVVADNGDLGRVXFGLVVLAQIGAGGGFDTQRHYVVVGXRAGGSAVDGGFRADRRAADDCADAAAEGKAEDGGSQGADGVRFGFHRVLPFLGVSDGIALRHAV

SEQ ID NO: 138 - protein, 459 aa, Neisseria
MMMPFIMLPWIAGVPAVPGQKRLSRISLWGLAGVFFGVSGLVWFSLGVSFSLGVSLGCACFSGVSFRGSGWGAFVGSTGVSLSVFSACVPVPVNESAARAASEGRGLTRFFLGAAGDGSPLPLSSVPSGCAGSDEAAWWCSGWAASCPTAPFGSQNSVSRGLSVCCGSVWRVLSPFGLNVLTMPTANAPMAVIQMSNTARIRSLGVSLKGLFGFFAILIVLLGCRAMPSEGGSDGIAESALDVVLVEGNDFLYADGGADFLGNLRLFFGGEDAHNVGYIAVGNDFDARLCSGADAQQRGADFGRVPSVAGDVARSARQGGDGNVVVYAFGGLFGTCNLTDELFFAFGGDLSEQQQVAVVADDGDLGRVAFGLVVLAQVGTGGGFDTQRHNVVIGLRAGGSAVDDGFCADGGPADDCAEAAAEGKAEDGGNQGADGVWFGFHRGLPFLGVSDGIALRHAV

SEQ ID NO: 139 - protein, 93 aa, Neisseria
  VARIANT (1)...(93): Xaa = Any Amino Acid
MKTFFKTLSAAALALILAACGXQKDSAPAASASAAADNGAAKKEIVFGTTVGDFGDMVKEQIQAELEKKGYTVKLVEFTDYVRPNLALAEGEL

SEQ ID NO: 140 - protein, 287 aa, Neisseria
MKTFFKTLSAAALALILAACGGQKDSAPAASASAAADNGAAKKEIVFGTTVGDFGDMVKEQIQAELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 141 - protein, 287 aa, Neisseria
  VARIANT (1)...(287): Xaa = Any Amino Acid
MKTFFKTLSAAALALILAACGGQKDSAPAASASAAADNGAAXKEIVFGTTVGDFGDMVKEXIQPELEKKGYTVKLVEXTDYVRXNLALAEGELDINVXQHXXYLDDXKKXHNLDITXVXQVPTAPLGLYPGKLKSLXXVKXGSTVSAPNDPXXFXRVLVMLDELGXIKLKDXIXXXXXXXXXXXXXXXXXXXXXXXXXXXXXXXAXXXXXXXXXXXXXXSGMKLTEALFQEPSFAYVNWSAVKTADKDSQWLKDVTEAYNSDAFKAYAHKRFEGYKSPAAWNEGAAK

SEQ ID NO: 142 - protein, 287 aa, Neisseria
MKTFFKTLSAAALALILAACGGQKDSAPAASASAAADNGAAKKEIVFGTTVGDFGDMVKEQIQPELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 143 - protein, 288 aa, Neisseria
MKTFFKTLSTASLALILAACGGQKDSAPAASAAAPSADNGAAKKEIVFGTTVGDFGDMVKEQIQAELEKKGYTVKLVEFTDYVRPNLALAEGELDINVFQHKPYLDDFKKEHNLDITEAFQVPTAPLGLYPGKLKSLEEVKDGSTVSAPNDPSNFARALVMLNELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKYPAAWNEGAAK

SEQ ID NO: 144 - protein, 288 aa, Neisseria
MKTFFKTLSAAALALILAACGGQKDSAPAASAAAPSADNGAAKKEIVFGTTVGDFGDMVKEQIQAELEKKGYTVKLVEFTDYVRPNLALAEGELDINVFQHKPYLDDFKKEHNLDITEAFQVPTAPLGLYPGKLKSLEEVKDGSTVSAPNDPSNFARALVMLNELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKYPAAWNEGAAK

SEQ ID NO: 145 - protein, 318 aa, Neisseria
  VARIANT (1)...(318): Xaa = Any Amino Acid
XXXXXXPRRPRHAPVSRGDLLQGGGTYARHGHRAGRGFGRFMAEPALFPRQPPLLPHRRHGKRTGRLGGGRQKRLRPXAGRADDVYAHRRQRQRMARQRTHARHERPHRRGHRHRRRQTAAAEIHTDVAFHACRQPGRLQQNDCRNQQRQAHDPRTPRGEHGENAPNQRTHGQKPQPSRRHIGRKLHQPRHDGSHAARPPXNRQHHRAAPDHRRQAAISQTQRQRNPAAXPPLHTAPNXXXXXXXXXXXQTRPPHPHRHRHQPRTGSPRRTPPLPMAGLPLAQHRYASGNFRPRHPAATHPPQMAGCPRTPTPAPKPA

SEQ ID NO: 146 - protein, 318 aa, Neisseria
MDRDDRLRRPRHAPVPRRDLLQRGGTYARYGHRAGRGFGRFMAEPALFPRQPPLLPDHRHGKRTGRLGGGRQKRLRPYVGGADDVHAHRRQRQRMARQRPDARDERPHRRRHRHCRRQTAAAEIHTDVAFHACRQPGRLQQNDCRNQQRQAYDARTFGAEYGQNAPNQRTHGQKPQPPRRHIGRKPHQPLHDGSHAARPPQNRQHHRAAPDHRRQAAISQTQRQRNPAARPPLHTAPNRPATNRRPHQRQTRPPHPHRHRHQPRTGSPRRTPPLPMAGFPLAQHQYASGNFRPRHPPATHPPQMAGCPRTPTPAPKPA

SEQ ID NO: 147 - protein, 189 aa, Neisseria
  VARIANT (1)...(189): Xaa = Any Amino Acid
EISLRSDXRPVSVXKRRDSERFLLLDGGNSRLKWAWVENGTFATVGSAPYRDLSPLGAEWAEKADGNVRIVGCAVCGEFKKAQVQEQLARKIEWLPSSAQAXGIRNHYRHPEEHGSDRWFNALGSRRFSRNACVVVSCGTAVTVDALTDDGHYLGXGTIMPGFHLMKESLAVRTANLNRHAGKRYPFPT

SEQ ID NO: 148 - protein, 592 aa, Neisseria
MTVLKLSHWRVLAELADGLPQHVSQLARMADMKPQQLNGFWQQMPAHIRGLLRQHDGYWRLVRPLAVFDAEGLRELGERSGFQTALKHECASSNDEILELARIAPDKAHKTICVTHLQSKGRGRQGRKWSHRLGECLMFSFGWVFDRPQYELGSLSPVAAVACRRALSRLGLDVQIKWPNDLVVGRDKLGGILIETVRTGGKTVAVVGIGINFVLPKEVENAASVQSLFQTASRRGNADAAVLLETLLVELDAVLLQYARDGFAPFVAEYQAANRDHGKAVLLLRDGETVFEGTVKGVDGQGVLHLETAEGKQTVVSGEISLRSDDRPVSVPKRRDSERFLLLDGGNSRLKWAWVENGTFATVGSAPYRDLSPLGAEWAEKADGNVRIVGCAVCGEFKKAQVQEQLARKIEWLPSSAQALGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIYGLLNMIAAEGREYEHI

SEQ ID NO: 149 - protein, 592 aa, Neisseria
MTVLKPSHWRVLAELADGLPQHVSQLARMADMKPQQLNGFWQQMPAHIRGLLRQHDGYWRLVRPLAVFDAEGLRELGERSGFQTALKHECASSNDEILELARIAPDKAHKTICVTHLQSKGRGRQGRKWSHRLGECLMFSFGWVFDRPQYELGSLSPVAAVACRRALSRLGLKTQIKWPNDLVVGRDKLGGILIETVRTGGKTVAVVGIGINFVLPKEVENAASVQSLFQTASRRGNADAAVLLETLLAELDAVLLQYARDGFAPFVAEYQAANRDHGKAVLLLRDGETVFEGTVKGVDGQGVLHLETAEGKQTVVSGEISLRSDDRPVSVPKRRDSERFLLLDGGNSRLKWAWVENGTFATVGSAPYRDLSPLGAEWAEKVDGNVRIVGCAVCGEFKKAQVQEQLARKIEWLPSSAQALGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIHGLLNLIAAEGGESEHT

SEQ ID NO: 150 - protein, 455 aa, Neisseria
MFSFGWAFDRPQYELGSLSPVAALACRRALGCLGLETQIKWPNDLVVGRDKLGGILIETVRAGGKTVAVVGIGINFVLPKEVENAASVQSLFQTASRRGNADAAVLLETLLAELGAVLEQYAEEGFAPFLNEYETANRDHGKAVLLLRDGETVCEGTVKGVDGRGVLHLETAEGEQTVVSGEISLRPDNRSVSVPKRPDSERFLLLEGGNSRLKWAWVENGTFATVGSAPYRDLSPLGAEWAEKADGNVRIVGCAVCGESKKAQVKEQLARKIEWLPSSAQALGIRNHYRHPEEHGSDRWFNALGSRRFSRNACVVVSCGTAVTVDALTDDGHYLGGTIMPGFHLMKESLAVRTANLNRPAGKRYPFPTTTGNAVASGMMDAVCGSIMMMHGRLKEKNGAGKPVDVIITGGGAAKVAEALPPAFLAENTVRVADNLVIHGLLNLIAAEGGESEHA

SEQ ID NO: 151 - protein, 592 aa, Neisseria
MTVLKPSHWRVLAELADGLPQHVSQLAREADMKPQQLNGFWQQMPAHIRGLLRQHDGYWRLVRPLAVFDAEGLRDLGERSGFQTALKHECASSNDEILELARIAPDKAHKTICVTHLQSKGRGRQGRKWSHRLGECLMFSFGWAFDRPQYELGSLSPVAALACRRALGCLGLETQIKWPNDLVVGRDKLGGILIETVRAGGKTVAVVGIGINFVLPKEVENAASVQSLFQTASRRGNADAAVLLETLLAELGAVLEQYAEEGFAPFLNEYETANRDHGKAVLLLRDGETVCEGTVKGVDGRGVLHLETAEGEQTVVSGEISLRPDNRSVSVPKRPDSERFLLLEGGNSRLKWAWVENGTFATVGSAPYRDLSPLGAEWAEKADGNVRIVGCAVCGESKKAQVKEQLARKIEWLPSSAQALGIRNHYRHPEEHGSDRWFNALGSRRFSRNACVVVSCGTAVTVDALTDDGHYLGGTIMPGFHLMKESLAVRTANLNRPAGKRYPFPTTTGNAVASGMMDAVCGSIMMMHGRLKEKNGAGKPVDVIITGGGAAKVAEALPPAFLAENTVRVADNLVIHGLLNLIAAEGGESEHA

SEQ ID NO: 152 - protein, 216 aa, Neisseria
MFYQILALIIWSSSFIAAKYVYGGIDPALMVGVRLLIAALPALPACRRHVGKIPREEWKPLLIVSFVNYVLTLLLQFVGLKYTSAASASVIVGLEPLLMVFVGHFFFNDKARAYHWICGAAAFAGVALLMAGGAEEGGEVGWFGCLLVLLAGAGFCAAMRPTQRLIARIGAPAFTSVSIAAASLMCLPFSLALAQSYTVDWSVGMVLSLLYLGLGC

SEQ ID NO: 153 - protein, 284 aa, Neisseria
MFYQILALIIWSSSFIAAKYVYGGIDPALMVGVRLLIAALPALPACRRHVGKIPREEWKPLLIVSFVNYVLTLLLQFVGLKYTSAASASVIVGLEPLLMVFVGHFFFNDKARAYHWICGAAAFAGVALLMAGGAEEGGEVGWFGCLLVLLAGAGFCAAMRPTQRLIARIGAPAFTSVSIAAASLMCLPFSLALAQSYTVDWSVGMVLSLLYLGLGCGWYAYWLWNKGMSRVPANVSGLLISLEPVVGVLLAVLILGEHLSPVSALGVFVVIAATLVAGRLSHQK

SEQ ID NO: 154 - protein, 284 aa, Neisseria
MFYQILALIIWSSSFIAAKYVYGGIDPALMVGVRLLIAALPALPACRRHVGKIPREEWKPLLIVSFVNYVLTLLLQFVGLKYTSAASASVIVGLEPLLMVFVGHFFFNDKARAYHWICGAAAFAGVALLMAGGAEEGGEVGWFGCLLVLLAGAGFCAAMRPTQRLIARIGAPAFTSVSIAAASLMCLPFSLALAQSYTVDWSVGMVLSLLYLGVGCSWYAYWLWNKGMSRVPANVSGLLISLEPVVGVLLAVLILGEHLSPVSVLGVFVVIAATLVAGRLSHQK

SEQ ID NO: 155 - protein, 291 aa, Neisseria
MFYQILALIIWGSSFIAAKYVYGGIDPALMVGVRLLIAALPALPACRRHVGKIPREEWKPLLIVSFVNYVLTLLLQFVGLKYTSAASASVIVGLEPLLMVFVGHFFFNDKARAYHWICGAAAFAGVALLMAGGAEEGGEVGWFGCLLVLLAGAGFCAAMRPTQRLIARIGAPAFTSVSIAAASLMCLPFSLALAQSYTVDWSVGMVLSLLYLGLGCGWYAYWLWNKGMSRVPANASGLLISLEPVVGVLLAVLILGEHLSPVSALGVFVVIAATFAAGRLSRRDAQNGNAV

SEQ ID NO: 156 - protein, 394 aa, Neisseria
  VARIANT (1)...(394): Xaa = Any Amino Acid
MRRFLPIAAICAXXLXXGLTAATGSTSSLADYFWWIVAFSAMLLLVLSAVLARYVILLLKDRRDGVFGSXXAKXPXXXMFTLVAXLPGVFLFGFPAQFINGTINSWFGNDTHEALERSLNLSKSALNLAADNALGNAVPVQIDLIGAASLPGDMGRVLEHYAGSGFAQLALYNXASGKIEKSINPHKLDQPFPGKARWEKIQRAGSVRDLESIGGVLYAQGWLSAGTHXGRDYALFFRQPVPKGVAEDAVLIEKARAKYAELSYSKKGLQTFFLATLLIASLLSIFLALVMALYFARRFVEPVLSLAEGAKAVAQGDFSQTRPVLRNDEFGRLTXLFNHMTEQLSIAKDADERNRRREEAARHYLECVLEGLTTGVVVFDEQGCLKTFNKAAGT

SEQ ID NO: 157 - protein, 706 aa, Neisseria
MRRFLPIAAICAVVLLYGLTAATGSTSSLADYFWWIVAFSAMLLLVLSAVLARYVILLLKDRRDGVFGSQIAKRLSGMFTLVAVLPGVFLFGVSAQFINGTINSWFGNDTHEALERSLNLSKSALNLAADNALGNAVPVQIDLIGAASLPGDMGRVLEHYAGSGFAQLALYNAASGKIEKSINPHKLDQPFPGKARWEKIQRAGSVRDLESIGGVLYAQGWLSAGTHNGRDYALFFRQPVPKGVAEDAVLIEKARAKYAELSYSKKGLQTFFLATLLIASLLSIFLALVMALYFARRFVEPVLSLAEGAKAVAQGDFSQTRPVLRNDEFGRLTKLFNHMTEQLSIAKEADERNRRREEAARHYLECVLEGLTTGVVVFDEQGCLKTFNKAAEQILGMPLTPLWGSSRHGWHGVSAQQSLLAEVFAAIGAAAGTDKPVHVKYAAPDDAKILLGKATVLPEDNGNGVVMVIDDITVLIHAQKEAAWGEVAKRLAHEIRNPLTPIQLSAERLAWKLGGKLDEQDAQILTRSTDTIVKQVAALKEMVEAFRNYARSPSLKLENQDLNALIGDVLALYEAGPCRFAAELAGEPLTVAADTTAMRQVLHNIFKNAAEAAEEADVPEVRVKSETGQDGRIVLTVCDNGKGFGREMLHNAFEPYVTDKPAGTGLGLPVVKKIIEEHGGRISLSNQDAGGACVRIILPKTVKTYA

SEQ ID NO: 158 - protein, 706 aa, Neisseria
  VARIANT (1)...(706): Xaa = Any Amino Acid
MRRFLPIAAICAVVLLYGLTAATGSTSSLADYFWWIVAFSAMLLLVLSAVLARYVILLLKDRRDGVFGSQIAKRLSGMFTLVAVLPGVFLFGVSAQFINGTINSWFGNDTHEALERSLNLSKSALNLAADNALGNAIPVQIDXIGAASLPXDMGRVLEHYAGSGFAQLALYNAASGKIEKSINPHKLDQPFPGKARWEKIQQAGSVRDXESIGGVLYAXGWLSAXTHNGRDYALFFRQPVPKGVAEDAVLIEKARAXXXXLSYSKKGLQTFFLATLLIASLLSIFLALVMALYFARRFVEPVLSLAEGAKAVAQGDFSQTRPVLRNDEFGRLTKLFNHMTEQLSIAKEADERNRRREEAARHYLECVLEGLTTGVVVFDEQGCLKTFNKAAEQILGMPLTPLWGSSRHGWHGVSAQQSLLAEVFAAIGAAAGTDKPVHVKYAAPDDAKILLGKATVLPEDNXNGVVMVIDDITVLIHAQKEAAWGEVAKRLAHEIRNPLTPIQLSAERLAWKLGGKLDEXDAQILTRSTDTIIKQVAALKEMVEAFRNYXRSPSXQLENQDLNALIGDVLALYEAGPCRFAAELAGEPLMMAADTTAMRQVLHNIFKNAAEAAEEADVPEVRVKSEAGQDGRIVLTVCDNGKGFGREMLHNAFEPYVTDKPAGTGLXLPVVKKIIEEHGGXISLSNQDAGGAXVRIILPKTVETYA

SEQ ID NO: 159 - protein, 400 aa, Neisseria
MRRFLPIAAICAVVLLYGLTAATGSTSSLADYFWWIVSFSAMLLLVLSAVLARYVILLLKDRRNGVFGSQIAKRLSGMFTLVAVLPGLFLFGISAQFINGTINSWFGNDTHEALERSLNLSKSALDLAADNAVSNAVPVQIDLIGTASLSGNMGSVLEHYAGSGFAQLALYNAASGKIEKSINPHQFDQPLPDKEHWEQIQQTGSVRSLESIGGVLYAQGWLSAGTHNGRDYALFFRQPIPENVAQDAVLIEKARAKYAELSYSKKGLQTFFLVTLLIASLLSIFLALVMALYFARRFVEPILSLAEGAKAVAQGDFSQTRPVLRNDEFGRLTKLFNHMTEQLSIAKEADERNRRREEAARHYLECVLDGLTTGVVVSYPLSCCRTAVFSTCHSSPLSYF

SEQ ID NO: 160 - protein, 706 aa, Neisseria
MRRFLPIAAICAVVLLYGLTAATGSTSSLADYFWWIVSFSAMLLLVLSAVLARYVILLLKDRRNGVFGSQIAKRLSGMFTLVAVLPGLFLFGISAQFINGTINSWFGNDTHEALERSLNLSKSALDLAADNAVSNAVPVQIDLIGTASLSGNMGSVLEHYAGSGFAQLALYNAASGKIEKSINPHQFDQPLPDKEHWEQIQQTGSVRSLESIGGVLYAQGWLSAGTHNGRDYALFFRQPIPENVAQDAVLIEKARAKYAELSYSKKGLQTFFLVTLLIASLLSIFLALVMALYFARRFVEPILSLAEGAKAVAQGDFSQTRPVLRNDEFGRLTKLFNHMTEQLSIAKEADERNRRREEAARHYLECVLDGLTTGVVVFDEKGRLKTFNKAAEQILGMPLAPLWGSSRHGWHGVSAQQSLLAEVFAAIGAAAGTDKPVQVEYAAPDDAKILLGKATVLPEDNGNGVVMVIDDITVLIRAQKEAAWGEVAKRLAHEIRNPLTPIQLSAERLAWKLGGKLDDQDAQILTRSTDTIIKQVAALKEMVEAFRNYARAPSLKLENQDLNALIGDVLALYEAGPCRFEAELAGEPLMMAADTTAMRQVLHNIFKNAAEAAEEADMPEVRVKSETGQDGRIVLTVCDNGKGFGKEMLHNAFEPYVTDKPAGTGLGLPVVKKIIGEHGGRISLSNQDAGGACVRIILPKTVETYA

SEQ ID NO: 161 - protein, 155 aa, Neisseria
MYAFTAAQQQKALFRLVLFHILIIAASNYLVQFPFQIFGIHTTWGAFSFPFIFLATDLTVRIFGSHLARRIIFWVMFPALLLSYVFSVLFHNGSWTGLGALSEFNTFVGRIALASFAAYAIGQILDIFVFNKLRRLKAWWIAPNASTVIGHALDT

SEQ ID NO: 162 - protein, 228 aa, Neisseria
MYAFTAAQQQKALFRLVLFHILIIAASNYLVQFPFQIFGIHTTWGAFSFPFIFLATDLTVRIFGSHLARRIIFWVMFPALLLSYVFSVLFHNGSWTGLGALSEFNTFVGRIALASFAAYAIGQILDIFVFNKLRRLKAWWIAPTASTVIGNALDTLVFFAVAFYASSDGFMAANWQGIAFVDYLFKLTVCTLFFLPAYGVILNLLTKKLTTLQTKQAQDRPAPSLQNP

SEQ ID NO: 163 - protein, 228 aa, Neisseria
MYAFTAAQQQKALFWLVLFHILIIAASNYLVQFPFQISGIHTTWGAFSFPFIFLATDLTVRIFGSHLARRIIFWVMFPALLLSYVFSVLFHNGSWTGLGALSEFNTFVGRIALASFAAYALGQILDIFVFNKLRRLKAWWVAPTASTVIGNALDTLVFFAVAFYASSDGFMAANWQGIAFVDYLFKLTVCGLFFLPAYGVILNLLTKKLTTLQTKQAQDRPAPSLQNP

SEQ ID NO: 164 - protein, 228 aa, Neisseria
MYALTAAQQQKALFRLVLFHILIIAASNYLVQFPFRIFGIHTTWGAFSFPFIFLATDLTVRIFGSHLARRIIFWVMFPALSLSYVFSVLFHNGSWTGLGAPSQFNTFVGRIALASFAAYALGQILDIFVFDKLRRLKAWWIAPAASTVIGNALDTLVFFAVAFYASSDEFMAANWQGIAFVDYLFKLTVCTLFFLPAYGVILNLLTKKLTALQTKQAQDRPVPSLQNP

SEQ ID NO: 165 - protein, 173 aa, Neisseria
  VARIANT (1)...(173): Xaa = Any Amino Acid
MVIKYTNLNFAKLSIIAILMMYSFEANANAVXISETVSVDTGQGAKIHKFVPKNSKTYSSDLIKTVDLTHXPTGAKARINAKITASVSRAGVLAGVGKLARLGAKFSTRAVPYVGTALLAHDVYETFKEDIQARGYQYDPETDKFVKGYEYSNCLWYEDKRRINRTYGCYGVD

SEQ ID NO: 166 - protein, 150 aa, Neisseria
MVIKYTNLNFAKLSIIAILMMYSFEANANAVKISETVSVDTGQGAKIHKFVPKNSKTYSSDLIKTVDLTHIPTGAKARINAKITASVSRAGVLAGVGKLARLGAKFSTRAVPYVGTALLAHDVYETFKEDIQARGYQYDPETDKFAKVSG

SEQ ID NO: 167 - protein, 150 aa, Neisseria; identical to SEQ ID NO: 166

SEQ ID NO: 168 - protein, 526 aa, Neisseria
MVTKHTNLNFAKLSIIAILMMYSFEANANAVKISETLSVDTGQGAKVHKFVPKSSNIYSSDLTKAVDLTHIPTGAKARINAKITASVSRAGVLSGVGKLVRQGAKFGTRAVPYVGTALLAHDVYETFKEDIQARGCRYDPETDKFVKGYEYANCLWYEDERRINRTYGCYGVDSSIMRLMPDRSRFPEVKQLMESQMYRLARPFWNWRKEELNKLSSLDWNNFVLNRCTFDWNGGGCAVNKGDDFRAGASFSLGRNPKYKEEMDAKKPEEILSLKVDADPDKYIEATGYPGYSEKVEVAPGTKVNMGPVTDRNGNPVQVAATFGRDAQGNTTADVQVIPRPDLTPASAEAPHAQPLPEVSPAENPANNPDPDENPGTRPNPEPDPDLNPDANPDTDGQPGTSPDSPAVPDRPNGRHRKERKEGEDGGLSCDYFPEILACQEMGKPSDRMFHDISIPQVTDDKTWSSHNFLPSNGVCPQPKTFHVFGRQYRASYEPLCVFAEKIRFAVLLAFIIMSAFVVFGSLGGE

SEQ ID NO: 169 - protein, 145 aa, Neisseria
MVTKHTNLNFAKLSIIAILMMYSFEANANAVKISETLSVDTGQGAKVHKFVPKSSNIYSSDLTKAVDLTHIPTGAKARINAKITASVSRAGVLSGVGKLVRQGAKFGTRAVPYVGTALLAHDVYETFKEDIQARGCRYDPETDKF

SEQ ID NO: 170 - protein, 76 aa, Neisseria
MRFFGIGFLVLLFLEIMSIVWVADWLGGGWTLFLMAAGFAAGVLMLRQTGLTGLLLAGAAMRSGGKVSVYQMLWPI

SEQ ID NO: 171 - protein, 161 aa, Neisseria
MRFFGIGFLVLLFLEIMSIVWVADWLGGGWTLFLMAAGFAAGVLMLRHTGLSGLLLAGAAMRSGGRVSVYQMLWPIRYTVAAVCLMSPGFVSSVLAVLLLLPFKGGAVLQAGGAENFFNMNQSGRKEGFSRDDDIIEGEYTVEEPYGGNRSRNAIEHKKDE

SEQ ID NO: 172 - protein, 161 aa, Neisseria
  VARIANT (1)...(161): Xaa = Any Amino Acid
MRFFGIGFLVLLFLEIMSIVWVADWLGGGWTLFLMAATFAAGVVMLRHTGLSGLLLAGAAMRSGGRVSVYXMLWXIRYTVAAVCXMSPGFVSSVXAVLLXLPFKGGAVLQAGGAENFFNMNXSGRKXGXSRDDDIIEGEYTVEXPYGGXRFRNAXEHKKDE

SEQ ID NO: 173 - protein, 161 aa, Neisseria
MRFFGIGFLVLLFLEIMSIVWVADWLGGGWTLFLMAATFAAGVLMLRHTGLSGLLLAGAAVKSSGKVSVYQMLWPIRYTVAAVCLMSPGFVSSVLAVLLLLPFKGGAVLQAGGAENFFNMNQSGRKEGFFHDDDIIEGEYTVEKPDGGNRSRNAIEHEKDE

SEQ ID NO: 174 - protein, 292 aa, Neisseria
  VARIANT (1)...(292): Xaa = Any Amino Acid
MFVFQTAFXMFQKHLQKASDSVVGGTLYVVATPIGNLADITLRALAVLQKAXXXXAEDTRVTAQLLSAYGIQGKLVSVREHNERQMADKIVGYLSDGMVVAQVSDAGTPAVCDPGAKLARRVREAGFKVVPVVGAXAVMAALSVAGVEGSDFYFNGFVPPKSGERRKLFAKWVRAAFPIVMFETPHRIGAALADMAELFPERRLMLAREITKTFETFLSGTVGEIQTALSADGDQSRGEMVLVLYPAQDEKHEGLSESAQNIMKILTAELPTKQAAELAAKITGEGKKALYD

SEQ ID NO: 175 - protein, 291 aa, Neisseria
MFQKHLQKASDSVVGGTLYVVATPIGNLADITLRALAVLQKADIICAEDTRVTAQLLSAYGIQGKLVSVREHNERQMADKIVGYLSDGMVVAQVSDAGTPAVCDPGAKLARRVREAGFKVVPVVGASAVMAALSVAGVEGSDFYFNGFVPPKSGERRKLFAKWVRAAFPIVMFETPHRIGATLADMAELFPERRLMLAREITKTFETFLSGTVGEIQTALSADGNQSRGEMVLVLYPAQDEKHEGLSESAQNIMKILTAELPTKQAAELAAKITGEGKKALYDLALSWKNK

SEQ ID NO: 176 - protein, 291 aa, Neisseria
MFQKHLQKASDSVVGGTLYVVATPIGNLADITLRALAVLQKADIICAEDTRVTAQLLSAYGIQGKLVSVREHNERQMADKIVGYLSDGMVVAQVSDAGTPAVCDPGAKLARRVREVGFKVVPVVGASAVMAALSVAGVAGSDFYFNGFVPPKSGERRKLFAKWVRVAFPVVMFETPHRIGATLADMAELFPERRLMLAREITKTFETFLSGTVGEIQTALAADGNQSRGEMVLVLYPAQDEKHEGLSESAQNIMKILTAELPTKQAAELAAKITGEGKKALYDLALSWKNK

SEQ ID NO: 177 - protein, 300 aa, Neisseria
MSVFQTAFFMFQKHLQKASDSVVGGTLYVVATPIGNLADITLRALAVLQKADIICAEDTRVTAQLLSAYGIQGRLVSVREHNERQMADKVIGFLSDGLVVAQVSDAGTPAVCDPGAKLARRVREAGFKVVPVVGASAVMAALSVAGVAESDFYFNGFVPPKSGERRKLFAKWVRAAFPVVMFETPHRIGATLADMAELFPERRLMLAREITKTFETFLSGTVGEIQTALAADGNQSRGEMVLVLYPAQDEKHEGLSESAQNAMKILAAELPTKQAAELAAKITGEGKKALYDLALSWKNK

SEQ ID NO: 178 - protein, 291 aa, Neisseria
MFQKHLQKASDSVVGGTLYVVATPIGNLADITLRALAVLQKADIICAEDTRVTAQLLSAYGIQGRLVSVREHNERQMADKVIGFLSDGLVVAQVSDAGTPAVCDPGAKLARRVREAGFKVVPVVGASAVMAALSVAGVAESDFYFNGFVPPKSGERRKLFAKWVRAAFPVVMFETPHRIGATLADMAELFPERRLMLAREITKTFETFLSGTVGEIQTALAADGNQSRGEMVLVLYPAQDEKHEGLSESAQNAMKILAAELPTKQAAELAAKITGEGKKALYDLALSWKNK

SEQ ID NO: 179 - protein, 251 aa, Neisseria
  VARIANT (1)...(251): Xaa = Any Amino Acid
MKQKKTAAAVIAAMLAGFAAXKAPEIDPALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXELVRNQLEQGLRQEKARLKIDALLEENGVKP

SEQ ID NO: 180 - protein, 252 aa, Neisseria
MKQKKTAAAVIAAMLAGFAAAKAPEIDPALVDTLVAQIMQQADRHAEQSQKPDGQAIRNDAVRRLQTLEVLKNRALKEGLDKDKDVQNRFKIAEASFYAEEYVRFLERSETVSEDELHKFYEQQIRMIKLQQVSFATEEEARQAQQLLLKGLSFEGLMKRYPNDEQAFDGFIMAQQLPEPLASQFAAMNRGDVTRDPVKLGERYYLFKLSEVGKNPDAQPFELVRNQLEQGLRQEKARLKIDALLEENGVKP

SEQ ID NO: 181 - protein, 252 aa, Neisseria
MKQKKTAAAVIAAMLAGFAAAKAPEIDPALVDTLVAQIMQQADRHAEQSQKPDGQAIRNDAVRRLQTLEVLKNRALKEGLDKDKDVQNRFKIAEASFYAEEYVRFLERSETVSESALRQFYERQIRMIKLQQVSFATEEEARQAQQLLLKGLSFEGLMKRYPNDEQAFDGFIMAQQLPEPLASQFAAMNRGDVTRDPVKLGERYYLFKLSEVGKNPDAQPFELVRNQLEQGLRQEKARLKIDAILEENGVKP

SEQ ID NO: 182 - protein, 252 aa, Neisseria
MKQKKTAAAVIAAMLAGFAAAKAPEIDPALVDTLVAQIMQQADRHAEQSQRPDGQAIRNDAVRRLQTLEVLKNRALKEGLDKDKDVQNRFKIAEASFYAEEYVRFLERSETVSESALRQFYERQIRMIKLQQVSFATEEEARQAQQLLLKGLSFEGLMKRYPNDEQAFDGFIMAQQLPEPLASQFAGMNRGDVTRNPVKLGERYYLFKLGAVGKNPDAQPFELVRNQLEQGLRQEKARLKIDALLEENGVKP

SEQ ID NO: 183 - protein, 524 aa, Neisseria
  VARIANT (1)...(524): Xaa = Any Amino Acid
MKKSFLTLVLYSSLLTASEIAYPLELGIETLPAAKIAETFALTFVIAALYLFARNKVTRLLIAVFFAFSIIANNVHYADYQSWMTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQTVFEQLQKTPDGNWLFAYTSDHGQYVRQDIYNQGTVQPDSYLVPLVLYSPDKAVQQAANQAFAPCEIAFHQQLSTFLIHTLGYDMPVSGCREGSVTGNLITGDAGSLNIRDGKAEYVYPQ

SEQ ID NO: 184 - protein, 524 aa, Neisseria
MKKSFLTLVLYSSLLTASEIAYRFVFGIETLPAAKIAETFALTFVIAALYLFARYKVTRLLIAVFFAFSIIANNVHYAVYQSWMTGINYWLMLKEVTEVGSAGASMLDKLWLPVLWGVLEVMLFCSLAKFRRKTHFSADILFAFLMLMIFVRSFDTKQEHGISPKPTYSRIKANYFSFGYFVGRVLPYQLFDLSRIPAFKQPAPSKIGQGSVQNIVLIMGESESAAHLKLFGYGRETSPFLTRLSQADFKPIVKQSYSAGFMTAVSLPSFFNAIPHANGLEQISGGDTNMFRLAKEQGYETYFYSAQAENEMAILNLIGKKWIDHLIQPTQLGYGNGDNMPDEKLLPLFDKINLQQGKHFIVLHQRGSHAPYGALLQPQDKVFGEADIVDKYDNTIHKTDQMIQTVFEQLQKQPDGNWLFAYTSDHGQYVRQDIYNQGTVQPDSYLVPLVLYSPDKAVQQAANQAFAPCEIAFHQQLSTFLIHTLGYDMPVSGCREGSVTGNLITGDAGSLNIRDGKAEYVYPQ

SEQ ID NO: 185 - protein, 424 aa, Neisseria
MKKSLFVLFLYSSLLTASEIAYRFVFGIETLPAAKMAETFALTFVIAALYLFARYKATRLLIAVFFAFSIIANNVHYAVYQSWITGINYWLMLKEITEVGGAGASMLDKLWLPALWGVLEVMLFCSLAKFRRKTHFSADILFAFLMLMIFVRSFDTKQEHGISPKPTYSRIKANYFSFGYFVGRVLPYQLFDLSKIPVFKQPAPSRIGQGSIQNIVLIMGESESAAHLKLFGYGRETSPFLTQLSQADFKPIVKQSYSAGFMTAVSLPSFFNVIPHANGLEQISGGDIVDKYDNTIHKTDQMIQTVFEQLQKQPDGNWLFAYTSDHGQYVRQDIYNQGTVQPDSYLVPLVLYSPDKAVQQAANQAFAPCEIAFHQQLSTFLIHTLGYDMPVSGCREGSVTGNLITGDAGSLNIRDGKAEYVYPQ

SEQ ID NO: 186 - protein, 524 aa, Neisseria
MKKSLFVLFLYSSLLTASEIAYRFVFGIETLPAAKMAETFALTFMIAALYLFARYKASRLLIAVFFAFSMIANNVHYAVYQSWMTGINYWLMLKEVTEVGSAGASMLDKLWLPALWGVAEVMLFCSLAKFRRKTHFSADILFAFLMLMIFVRSFDTKQEHGISPKPTYSRIKANYFSFGYFVGRVLPYQLFDLSKIPVFKQPAPSKIGQGSIQNIVLIMGESESAAHLKLFGYGRETSPFLTRLSQADFKPIVKQSYSAGFMTAVSLPSFFNVIPHANGLEQISGGDTNMFRLAKEQGYETYFYSAQAENQMAILNLIGKKWIDHLIQPTQLGYGNGDNMPDEKLLPLFDKINLQQGRHFIVLHQRGSHAPYGALLQPQDKVFGEADIVDKYDNTIHKTDQMIQTVFEQLQKQPDGNWLFAYTSDHGQYVRQDIYNQGTVQPDSYIVPLVLYSPDKAVQQAANQAFAPCEIAFHQQLSTFLIHTLGYDMPVSGCREGSVTGNLITGDAGSLNIRNGKAEYVYPQ

SEQ ID NO: 187 - protein, 197 aa, Neisseria
  VARIANT (1)...(197): Xaa = Any Amino Acid
TLLLFIPLVLTXCGTLTGILAHGGGKRFAVEQELVAASSRAAVKEMDLSALKGRKAAXYVSVMGDQGSGNISGGRYSIDALIRGGYHNNPESATQYSYPAYDTTATTKSDALSSVTTSTSLLNAPAAXLTKNSGRKGERSAGLSVNGTGDYRNETLLANPRDVSFLTNLIQTVFYLRGIEVVPPXYADTDVFVTVDV

SEQ ID NO: 188 - protein, 313 aa, Neisseria
MKTLLLLIPLVLTACGTLTGIPAHGGGKRFAVEQELVAASSRAAVKEMDLSALKGRKAALYVSVMGDQGSGNISGGRYSIDALIRGGYHNNPESATQYSYPAYDTTATTKSDALSSVTTSTSLLNAPAAALTKNSGRKGERSAGLSVNGTGDYRNETLLANPRDVSFLTNLIQTVFYLRGIEVVPPEYADTDVFVTVDVFGTVRSRTELHLYNAETLKAQTKLEYFAVDRDSRKLLITPKTAAYESQYQEQYALWTGPYKVSKTVKASDRLMVDFSDITPYGDTTAQNRPDFKQNNGKKPDVGNEVIRRRKGG

SEQ ID NO: 189 - protein, 313 aa, Neisseria
  VARIANT (1)...(313): Xaa = Any Amino Acid
MKTLLXLIPLVLTACGTLTGIPAHGGGKRFAVEQELVAASSRAAVKEMDLSALKGRKAALYVSVMGDQGSGNISGGRYSIDALIRGGYHNNPESATQYSYPAYDTTATTKSDALSSVTTSTSLLNAPAAALTKNSGRKGERSAGLSVNGTGDYRNETLLANPRDVSFLTNLIQTVFYLRGIEVVPPEYADTDVFVTVDVFGTVRSRTELHLYNAETLKAQTKLEYFAVDRDSRKLLIAPKTAAYESQYQEQYALWMGPYSVGKTVKASDRLMVDFSDITPYGDTTAQNRPDFKQNNGKKPDVGNEVIRRRKGG

SEQ ID NO: 190 - protein, 313 aa, Neisseria
MKTLLLLIPLVLTACGTLTGIPAHGGGKRFAVEQELVAASSRAAVKEMDLSALKGRKAALYVSVMGDQGSGNISGGRYSIDALIRGGYHNNPDSATRYSYPAYDTTATTKSDALSGVTTSTSLLNAPAAALTKNNGRKGERSAGLSVNGTGDYRNETLLANPRDVSFLTNLIQTVFYLRGIEVVPPEYADTDVFVTVDVFGTVRSRTELHLYNAETLKAQTKLEYFAVDRDSRKLLIAPKTAAYESQYQEQYALWMGPYSVGKTVKASDRLMVDFSDITPYGDTTAQNRPDFKQNNGKNPDVGNEVIRRRKGG

SEQ ID NO: 191 - protein, 395 aa, Neisseria
  VARIANT (1)...(395): Xaa = Any Amino Acid
MAEICLITGTPGSGKTLKMVSMMANDEMFKPDEKAIRRKVFTNIKGLKIPHTYIETDAKKLPKSTDEQLSAHDMYEWIKKPENIGSIVIVDEAQDVWPARSAGSKIPENVQWLNTHRHQGIDIFVLTQGPKLLDQNLRTLVRKHYHIASNKMGMRTLLEWKICADDPVKMASSAFSSIYTLDKKVYDLYXXAEVHTVNKVKRSKWFYTLPVIVLLIPVFVGLSYKMLSSYGKKQEEPAAQESAATEQQAVLPDKTEGEPVNNGNLTADMFVPTLSEKPXSKPIYNGVRQVRTFEYIAGCIEGGRTGCACYSHQGTALKEVTELMCKDYVKNGLPFNPYKEESQGQEVQQSAQQHSDRAQVATLGGKPXQNLMYDNWEERGKPFEGIGGGVVGSAN

SEQ ID NO: 192 - protein, 394 aa, Neisseria
MAEICLITGTPGSGKTLKMVSMMANDEMFKPDENGIRRKVFTNIKGLKIPHTYIETDAKKLPKSTDEQLSAHDMYEWIKKPENIGSIVIVDEAQDVWPARSAGSKIPENVQWLNTHRHQGIDIFVLTQGPKLLDQNLRTLVRKHYHIASNKMGMRTLLEWKICADDPVKMASSAFSSIYTLDKKVYDLYESAEVHTVNKVKRSKWFYTLPVIVLLIPVFVGLSYKMLSSYGKKQEEPAAQESAATEQQAVLPDKTEGEPVNNGNLTADMFVPTLSEKPESKPIYNGVRQVRTFEYIAGCIEGGRTGCACYSHQGTALKEVTELMCKDYVKNGLPFNPYKEESQGQEVQQSAQQHSDRAQVATLGGKPQNLMYDNWEERGKPFEGIGGGVVGSAN

SEQ ID NO: 193 - protein, 395 aa, Neisseria
MAEICLITGTPGSGKTLKMVSMMANDEMFKPDENGIRRKVFTNIKGLKIPHTYIETDAKKLPKSTDEQLSAHDMYEWIKKPENIGSIVIVDEAQDVWPARSAGSKIPENVQWLNTHRHQGIDIFVLTQGSKLLDQNLRTLVRKHYHIASNKMGMRTLLEWKICADDPVKMASSAFSSIYTLDKKVYDLYESAEVHTVNKVKRSKWFYTLPVIILLIPVFVGLSYKMLSSYGKKQEEPAAQESAATEHQAVFQDKTEGEPVNNGNLTADMFVPTLSEKPESKPIYNGVRQVRTFEYIAGCVEGGRTGCTCYSHQGTALKEITKEMCKDYARNGLPFNPYKEESQGRDVQQSEQHHSDRPQVATLGGKPWQNLMYDNWQERGKPFEGIGGGVVGSAN

SEQ ID NO: 194 - protein, 395 aa, Neisseria
MAEICLITGTPGSGKTLKMVSMMANDEMFKPDENGVRRKVFTNIKGLKIPHTHIETDAKKLPKSTDEQLSAHDMYEWIKKPENVGAIVIVDEAQDVWPARSAGSKIPENVQWLNTHRHQGIDIFVLTQGPKLLDQNLRTLVKRHYHIAANKMGLRTLLEWKVCADDPVKMASSAFSSIYTLDKKVYDLYESAEIHTVNKVKRSKWFYALPVIILLIPLFVGLSYKMLGSYGKKQEEPAAQESAATEQQAVLPDKTEGESVNNGNLTADMFVPTLPEKPESKPIYNGVRQVRTFEYIAGCIEGGRTGCTCYSHQGTALKEVTELMCKDYVKNGLPFNPYKEESQGQEVQQSAQQHSDRAQVATLGGKPQQNLMYDNWEERGKPFEGIGGGVVGSAN

SEQ ID NO: 195 - protein, 371 aa, Neisseria
  VARIANT (1)...(371): Xaa = Any Amino Acid
MVFLNADNGILVQDLPFEVKLKKFHIDFYNTGMPRDFASDIEVTDKATGEKLERTIRVNHPLTLHGITIYQASFADGGSDLTFKAWNLGDASREPVVLKATSIHQFPLEIGKHKYRLEFDQFTSMNVEDMSEGAEREKSLKSTLPDVRAVTQEGHKYTNXXXXXXYRIRDAPGQAVEYKNYMLPVLQEQDYFWITGTRSXLQQQYRWLRIPLDKQLKADTFMALREFLKDGEGRKRXVADATKGAPAEIREQFMLAAENTLNIFAQKGYLGLDEFITSNIPKEQQDKMQGYFYEMLYGVMNAALDETXTRYGLPEWQQDEARNRFLLHSMDAYTGLTEYPAPMLLQLDGFSEVRSSGLQMTRSXGPLLVYL

SEQ ID NO: 196 - protein, 671 aa, Neisseria
MSKSRRSPPLLSRPWFAFFSSMRFAVALLSLLGIASVIGTVLQQNQPQTDYLVKFGSFWAQIFGFLGLYDVYASAWFVVIMMFLVVSTSLCLIRNVPPFWREMKSFREKVKEKSLAAMRHSSLLDVKIAPEVAKRYLEVQGFQGKTINREDGSVLIAAKKGTMNKWGYIFAHVALIVICLGGLIDSNLLLKLGMLTGRIVPDNQAVYAKDFKPESILGASNLSFRGNVNISEGQSADVVFLNADNGILVQDLPFEVKLKKFHIDFYNTGMPRDFASDIEVTDKATGEKLERTIRVNHPLTLHGITIYQASFADGGSDLTFKAWNLGDASREPVVLKATSIHQFPLEIGKHKYRLEFDQFTSMNVEDMSEGAEREKSLKSTLNDVRAVTQEGKKYTNIGPSIVYRIRDAAGQAVEYKNYMLPVLQEQDYFWITGTRSGLQQQYRWLRIPLDKQLKADTFMALREFLKDGEGRKRLVADATKGAPAEIREQFMLAAENTLNIFAQKGYLGLDEFITSNIPKEQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVLMFYVREKRAWVLFSDGKIRFAMSSARSERDLQKEFPKHVESLQRLGKDLNHD

SEQ ID NO: 197 - protein, 671 aa, Neisseria; identical to SEQ ID NO: 196

SEQ ID NO: 198 - protein, 434 aa, Neisseria
  VARIANT (1)...(434): Xaa = Any Amino Acid
MVFLNADNGMLVQDLPFEVKLKKFHIDFYNTGMPRDFASDIEVTDKATGEKLERTIRVNHPLTLHGITIYQASFADGGSDLTFKAWNLRDASREPVVLKATSIHQFPLEIGKHKYRLEFDQFTSMNVEDMSEGAEREKSLKSTLNDVRAVTQEGKKYTNIGPSIVYRIRDAAGQAVEYKNYMLPILQDKDYFWLTGTRSGLQQQYRWLRIPLDKQLKADTFMALREFLKDGEGRKRLVADATKDAPAEIREQFMLAAENTLNIFAQKGYLGLDEFITSNIPKGQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVFMFYVPKKRAWVLFSNXKIRFAMSSARSERDLQKEFPKHVESLQRLGKDLNHD

SEQ ID NO: 199 - protein, 671 aa, Neisseria
MSKSRISPTLLSRPWFAFFSSMRFAVALLSLLGIASVIGTVLQQNQPQTDYLVKFGPFWTRIFDFLGLYDVYASAWFVVIMMFLVVSTSLCLIRNVPPFWREMKSFREKVKEKSLAAMRHSSLLDVKIAPEVAKRYLEVRGFQGKTVSREDGSVLIAAKKGTMNKWGYIFAQVALIVICLGGLIDSNLLLKLGMLAGRIVPDNQAVYAKDFKPESILGASNLSFRGNVNISEGQSADVVFLNADNGMLVQDLPFEVKLKKFHIDFYNTGMPRDFASDIEVTDKATGEKLERTIRVNHPLTLHGITIYQASFADGGSDLTFKAWNLRDASREPVVLKATSIHQFPLEIGKHKYRLEFDQFTSMNVEDMSEGAEREKSLKSTLNDVRAVTQEGKKYTNIGPSIVYRIRDAAGQAVEYKNYMLPILQDKDYFWLTGTRSGLQQQYRWLRIPLDKQLKADTFMALREFLKDGEGRKRLVADATKDAPAEIREQFMLAAENTLNIFAQKGYLGLDEFITSNIPKGQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVFMFYVREKRAWVLFSDGKIRFAMSSARSERDLQKEFPKHVESLQRLGKDLNHD

SEQ ID NO: 200 - protein, 162 aa, Neisseria
  VARIANT (1)...(162): Xaa = Any Amino Acid
MMSNXMXQKGFTLIXXMIVVAILGIISVIAIPSYXSYIEKGYQSQLYTEMXGINNISKQFILKNPLDDNQTIENKLEIFVSGYKMNPKIAKKYSVSVKFVDKEKSRAYRLVGVPKAGTGYTLSVWMNSVGDGYKCRDAASAQAHLETLSSDVGCEAFSNRKK

SEQ ID NO: 201 - protein, 162 aa, Neisseria
MMSNKMEQKGFTLIEMMIVVAILGIISVIAIPSYQSYIEKGYQSQLYTEMVGINNISKQFILKNPLDDNQTIENKLEIFVSGYKMNPKIAKKYSVSVKFVDKEKSRAYRLVGVPKAGTGYTLSVWMNSVGDGYKCRDAASAQAHLETLSSDVGCEAFSNRKK

SEQ ID NO: 202 - protein, 162 aa, Neisseria
  VARIANT (1)...(162): Xaa = Any Amino Acid
MMSNKMEQKGFTLIXXXXXXAIXXXXSVIXXXXYXSYIEKGYQSQLYTEMVGINNISKQXILKNPLDDNQTIKSKLEIFVSGYKMNPKIAEKYNVSVHFVNEEKPRAYSLVGVPKTGTGYTLSVWMNSVGDGYKCRDAASARAHLETLSSDVGCEAFSNRKK

SEQ ID NO: 203 - protein, 162 aa, Neisseria
MMSNKMEQKGFTLIEMMIVVTILGIISVIAIPSYQSYIEKGYQSQLYTEMVGINNVLKQFILKNPQDDNDTLKSKLKIFVSGYKMNPKIAKKYSVSVRFVDAEKPRAYRLVGVPNAGTGYTLSVWMNSVGDGYKCRDATSAQAYSDTLSADSGCEAFSNRKK

SEQ ID NO: 204 - protein, 93 aa, Neisseria
  VARIANT (1)...(93): Xaa = Any Amino Acid
MKKSSLISALGIGILSIGMAFAAPADAVSQIRQNATQVLSILKNGDANTARQKAEAYAIPYFDFQRMTALAVGNPWXTXSDXQKQALAXEFQP

SEQ ID NO: 205 - protein, 196 aa, Neisseria
MKKSSLISALGIGILSIGMAFAAPADAVSQIRQNATQVLSILKNGDANTARQKAEAYAIPYFDFQRMTALAVGNPWRTASDAQKQALAKEFQTLLIRTYSGTMLKLKNANVNVKDNPIVNKGGKEIIVRAEVGVPGQKPVNMDFTTYQSGGKYRTYNVAIEGASLVTVYRNQFGEIIKAKGVDGLIAELKAKNGGK

SEQ ID NO: 206 - protein, 196 aa, Neisseria
MKKSSFISALGIGILSIGMAFAAPADAVNQIRQNATQVLSILKSGDANTARQKAEAYAIPYFDFQRMTALAVGNPWRTASDAQKQALAKEFQTLLIRTYSGTMLKLKNANVNVKDNPIVNKGGKEIIVRAEVGVPGQKPVNMDFTTYQSGGKYRTYNVAIEGASLVTVYRNQFGEIIKAKGVDGLIAELKAKNGSK

SEQ ID NO: 207 - protein, 196 aa, Neisseria
VKKSSFISALGIGILSIGMAFASPADAVGQIRQNATQVLTILKSGDAASARPKAEAYAVPYFDFQRMTALAVGNPWRTASDAQKQALAKEFQTLLIRTYSGTMLKFKNATVNVKDNPIVNKGGKEIVVRAEVGIPGQKPVNMDFTTYQSGGKYRTYNVAIEGTSLVTVYRNQFGEIIKAKGIDGLIAELKAKNGGK

SEQ ID NO: 208 - protein, 196 aa, Neisseria
MKKSSFISALGIGILSIGMAFASPADAVGQIRQNATQVLTILKSGDAASARPKAEAYAVPYFDFQRMTALAVGNPWRTASDAQKQALAKEFQTLLIRTYSGTMLKFKNATVNVKDNPIVNKGGKEIVVRAEVGIPGQKPVNMDFTTYQSGGKYRTYNVAIEGTSLVTVYRNQFGEIIKAKGIDGLIAELKAKNGGK

SEQ ID NO: 209 - protein, 159 aa, Neisseria
  VARIANT (1)...(159): Xaa = Any Amino Acid
MKHILPLIAASALCISTASAHPASEPSTQNETAMITHTLISKYSFGXXXXXXXXAIKSKGMDIFAVIDHQEAARRNGLTMQPAKVIVFGTPKAGTPLMVKDPAFALQLPLRVLVTETDGKVRAAYTDTRALIAGSRIGFDEVANTLANAEKLIQKTVGE

SEQ ID NO: 210 - protein, 159 aa, Neisseria
MKHILPLIAASALCISTASAHPASEPSTQNETAMTTHTLTSKYSFDETVSRLETAIKSKGMDIFAVIDHQEAARRNGLTMQPAKVIVFGTPKAGTPLMVKDPAFALQLPLRVLVTETDGKVRAAYTDTRALIAGSRIGFDEVANTLANAEKLIQKTVGE

SEQ ID NO: 211 - protein, 159 aa, Neisseria
  VARIANT (1)...(159): Xaa = Any Amino Acid
MXHILPLXXASALCISTASXHPASEPQTQNETAMTTHTLTSKYSFDETVSRLETAIKSKGMDIFAVIDHQEAARRNGLTMQPAKVIVFGTPKAGTPLMVKDPAFALQLPLRVXVTETDGKVRAAYTDTRALIAGSRIGFDEVANTLANAEKLIQKTIGE

SEQ ID NO: 212 - protein, 159 aa, Neisseria
MKHILPPIAASAFCISTASAHPAGKPPTQNETAMTTHTLTSKYSFDETVSRLETAIKSKGMDIFAVIDHQEAARRNGLTMQPAKVIVFGTPKAGTPLMVKDPAFALQLPLRVLVTETDGKVRTAYTDTRALIVGSRISFDEVANTLANAEKLIQKTVGE

SEQ ID NO: 213 - protein, 159 aa, Neisseria
MKHILPLIAASALCISTASAHPAGKPPTQNETAMTTHTLTSKYSFDETVSRLETAIKSKGMDIFAVIDHQEAARRNGLTMQPAKVIVFGTPKAGTPLMVKDPAFALQLPLRVLVTETDGKVRTAYTDTRALIVGSRISFDEVANTLANAEKLIQKTVGE

SEQ ID NO: 214 - protein, 198 aa, Neisseria
MAFITRLFKSSKWLIVPLMLPAFQNVAAEGIDVSRAEARITDGGQLSISSRFQTELPDQLQQALRRGVPLNFTLSWQLSAPIIASYRFKLGQLIGDDDNIDYKLSFHPLTKRYRVTVGAFSTDYDTLDAALRATGAVANWKVLNKGALSGAEAGETKAEIRLTLSTSKLPKPFQINALTSQNWHLDSGWKPLNIIGNK

SEQ ID NO: 215 - protein, 198 aa, Neisseria
MAFITRLFKSSKWLIVPLMLPAFQNVAAEGIDVSRAEARITDGGQLSISSRFQTELPDQLQQALRRGVPLNFTLSWQLSAPIIASYRFKLGQLIGDDDNIDYKLSFHPLTNRYRVTVGAFSTDYDTLDAALRATGAVANWKVLNKGALSGAEAGETKAEIRLTLSTSKLPKPFQINALTSQNWHLDSGWKPLNIIGNK

SEQ ID NO: 216 - protein, 199 aa, Neisseria
  VARIANT (1)...(199): Xaa = Any Amino Acid
MAFITRLFKSIKQWLVLLPMLSVLPDAAAEGIDVSRAEARIXDGGQLSXXSRFQTELPDQLQXAXXRGVXLNXTLXWQLSAPIIASYRFXLGQLIGDDDXIDYKLSFHPLTNRYRVTVGAFSTXYDTLDAALRATGAVANWKVLNKGALSGAEAGETKAEIRLTLSTSKLPKPFQINALTSQNWHLDSGWKPLNIIGNK

SEQ ID NO: 217 - protein, 199 aa, Neisseria
MAFITRLFKSIKQWLVLLPILSVLPDAAAEGIAATRAEARITDGGRLSISSRFQTELPDQLQQALRRGVPLNFTLSWQLSAPTIASYRFKLGQLIGDDDNIDYKLSFHPLTNRYRVTVGAFSTDYDTLDAALRATGAVANWKVLNKGALSGAEAGETKAEIRLTLSTSKLPKPFQINALTSQNWHLDSGWKPLNIIGNK

SEQ ID NO: 218 - protein, 474 aa, Neisseria
  VARIANT (1)...(474): Xaa = Any Amino Acid
MDTKEILXYAAGSIGSAVLAVIILPLLSWYFPADDIGRIVLMQTAAGLTVSVLCLGLDQAYVREYYATADKDTLFKTLFLPPLLSAAAIAALLLSRPSLPSEILFSLDDAAAGIGLVLFELSFLPIRFLLLVLRMEGRALAFSSAQLVPKLAILLLXPLTVGLLHFPANTAVLTAVYALANLAAAAFLLFQNRCRLKAVRHAPFSPAVLHRGXRYGIPIALSSIAYWGLASADRLFLKKYAGLEQLGVYSMGISFGGAALLFQSIFSTVWTPYIFRAIEENAPPARLSATAESAAALLASALCXTGIFSPLASLLLPENYAAVRFIVVSCMXPPLFCTLAEISGIGLNVVRKTRPIALATLGALAANLLLLGLDRAVPARPXGAAVACAASFWLFFAFKTESSCRLWQPLKRLPLYLHTLFCLTSSAAYTCFGTPANYPLFAGVWAAYLAGCILRHRKDLHKLFHYLKKQGFPL

SEQ ID NO: 219 - protein, 473 aa, Neisseria
MDTKEILGYAAGSIGSAVLAVIILPLLSWYFPADDIGRIVLMQTAAGLTVSVLCLGLDQAYVREYYATADKDTLFKTLFLPPLLSAAAIAALLLSRPSLPSEILFSLDDAAAGIGLVLFELSFLPIRFLLLVLRMEGRALAFSSAQLVPKLAILLLLPLTVGLLHFPANTAVLTAVYALANLAAAAFLLFQNRCRLKAVRHAPFSPAVLHRGLRYGIPIALSSIAYWGLASADRLFLKKYAGLEQLGVYSMGISFGGAALLFQSIFSTVWTPYIFRAIEENAPPARLSATAESAAALLASALCLTGIFSPLASLLLPENYAAVRFIVVSCMLPPLFCTLAEISGIGLNVVRKTRPIALATLGALAANLLLLGLAVPSGGARGAAVACAASFWLFFAFKTESSCRLWQPLKRLPLYLHTLFCLTSSAAYTCFGTPANYPLFAGVWAAYLAGCILRHRKDLHKLFHYLKKQGFPL

SEQ ID NO: 220 - protein, 473 aa, Neisseria
MDTKEILGYAAGSIGSAVLAVIILPLLSWYFPADDIGRIVLMQTAAGLTVSVLCLGLDQAYVREYYAAADKDTLFKTLFLPPLLSAAAIAALLLSRPSLPSEILFSLDDAAAGIGLVLFELSFLPIRFLLLVLRMEGRALAFSSAQLVSKLAILLLLPLTVGLLHFPANTAVLTAVYALANLAAAAFLLFQNRCRLKAVRRAPFSSAVLHRGLRYGIPIALSSIAYWGLASADRLFLKKYAGLEQLGVYSMGISFGGAALLFQSIFSTVWTPYIFRAIEANAPPARLSATAESAAALLASALCLTGIFSPLASLLLPENYAAVRFIVVSCMLPPLFCTLVEISGIGLNVVRKTRPIALATLGALAANLLLLGLAVPSGGARGAAVACAASFWLFFVFKTESSCRLWQPLKRLPLYMHTLFCLASSAAYTCFGTPANYPLFAGVWAVYLAGCILRHRKDLHKLFHYLKKQGFPL

SEQ ID NO: 221 - protein, 473 aa, Neisseria
MDTKEILGYAAGSIGSAVLAVIILPLLSWYFPADDIGRIVLMQTAAGLTVSVLCLGLDQAYVREYYAAADKDTLFKTLFLPPLLFSAAIAALLLSRPSLPSEILFSLDDAAAGIGLVLFELSFLPIRFLLLVLRMEGRALAFSSAQLVPKLAILLLLPLTVGLLHFPANTSVLTAVYALANLAAAAFLLFQNRCRLKAVRRAPFSPAVLHRGLRYGIPLALSSLAYWGLASADRLFLKKYAGLEQLGVYSMGISFGGAALLLQSIFSTVWTPYIFRAIEENATPARLSATAESAAALLASALCLTGIFSPLASLLLPENYAAVRFTVVSCMLPPLFYTLTEISGIGLNVVRKTRPIALATLGALAANLLLLGLAVPSGGTRGAAVACAASFWLFFVFKTESSCRLWQPLKRLPLYMHTLFCLASSAAYTCFGTPANYPLFAGVWAAYLAGCILRHRKNLHKLFHYLKKQGFPL

SEQ ID NO: 222 - protein, 212 aa, Neisseria
  VARIANT (1)...(212): Xaa = Any Amino Acid
ILKPHNQLKEDIQPDPADQNALSEPDAATEAEQSDAENAADKQPVADKADEVEEKAGEPEREEPDGQAVRKKALTEEREQTVREKAQKKDAETVKIQAVKPSKETEKKASKEEKKAAKEKVAPKPTPEQILNSGSIEXARSAAAKEVQKMXNVRQGGSXRIICKWARMPTVRARKGSVPNWQSWAYLPRWSVIRRDIKRFTGCKAAICLPMR

SEQ ID NO: 223 - protein, 289 aa, Neisseria
MFMNKFSQSGKGLSGFFFGLILATVIIAGILFYLNQSGQNAFKIPASSKQPAETEILKPKNQPKEDIQPEPADQNALSEPDAATEAEQSDAEKAADKQPVADKADEVEEKAGEPEREEPDGQAVRKKALTEEREQTVREKAQKKDAETVKKQAVKPSKETEKKASKEEKKAAKEKVAPKPTPEQILNSGSIEKARSAAAKEVQKMKTSDKAEATHYLQMGAYADRQSAEGQRAKLAILGISSKVVGYQAGHKTLYRVQSGNMSADAVKKMQDELKKHEVASLIRSIESK

SEQ ID NO: 224 - protein, 289 aa, Neisseria
MFMNKFSQSGKGLSGFFFGLILATVIIAGILFYLNQSGQNAFKIPVPSKQPAETEILKPKNQPKEDIQPEPADQNALSEPDAAKEAEQSDAEKAADKQPVADKADEVEEKADEPEREKSDGQAVRKKALTEEREQTVGEKAQKKDAETVKKQAVKPSKETEKKASKEEKKAEKEKVAPKPTPEQILNSGSIEKARSAAAKEVQKMKTPDKAEATHYLQMGAYADRRSAEGQRAKLAILGISSKVVGYQAGHKTLYRVQSGNMSADAVKKMQDELKKHEVASLIRSIESK

SEQ ID NO: 225 - protein, 267 aa, Neisseria
MFMNKFSQSGKGLSGFFFGLILATVIIAGILLYLNQGGQNAFKIPAPSKQPAETEILKLKNQPKEDIQPEPADQNALSEPDVAKEAEQSDAEKAADKQPVADKADEVEEKAGEPEREEPDGQAVRKKALTEEREQTVREKAQKKDAETVKKKAVKPSKETEKKASKEEKKAAKEKVAPKPTPEQILNSRSIEKARSAAAKEVQKMKNFGQGGSQRIICKWARMPNPGARKGSVPNWQSWAYLPKWSAIRRDIKRFTACKAAICPPMR

SEQ ID NO: 226 - protein, 290 aa, Neisseria
MFMNKFSQSGKGLSGFFFGLILATVIIAGILLYLNQGGQNAFKIPAPSKQPAETEILKLKNQPKEDIQPEPADQNALSEPDVAKEAEQSDAEKAADKQPVADKADEVEEKAGEPEREEPDGQAVRKKALTEEREQTVREKAQKKDAETVKKQAVKPSKETEKKASKEEKKAAKEKVAPKPTPEQILNSRSIEKARSAAAKEVQKMKNFGQGGSQRIICKWARMPTVRSAEGQRAKLAILGISSEVVGYQAGHKTLYRVQSGNMSADAVKKMQDELKKHGVASLIRAIEGK

SEQ ID NO: 227 - protein, 222 aa, Neisseria
  VARIANT (1)...(222): Xaa = Any Amino Acid
MNHDITFLTLFLLGXFGGTHCIGMCGGLSSAFXXQLPPHINRFWLILLLNTGRVSSYTAIGLILGLIGQVGVSLDQTRVLQNILYTAANLLLLFLGLYLSGISSLAAKIEKIGKPIWRNLNPILNRLLPIKSIPACLAVGILWGWLPCGLVYSASLYALGSGSAATGGLYMLAFALGTLPNLLAIGIFSLQLXKIMQNRYIRLCTGLSVSLWALWKLAVLWL

SEQ ID NO: 228 - protein, 222 aa, Neisseria
MNHDITFLTLFLLGFFGGTHCIGMCGGLSSAFALQLPPHINRFWLILLLNTGRVSSYTAIGLILGLIGQVGVSLDQTRVLQNILYTAANLLLLFLGLYLSGISSLAAKIEKIGKPIWRNLNPILNRLLPIKSIPACLAVGILWGWLPCGLVYSASLYALGSGSAATGGLYMLAFALGTLPNLLAIGIFSLQLKKIMQNRYIRLCTGLSVSLWALWKLAVLWL

SEQ ID NO: 229 - protein, 222 aa, Neisseria
  VARIANT (1)...(222): Xaa = Any Amino Acid
MNXDITFLTLFLLGFFGGTHCIGMCGGLSSAFALQLPPHINRXWLILLLNTGRVSSYTAIGLILGLIGQVGVSLDQTRVXQNILYTAANLLLLFLGLYLSGISSLAAKIEKIGKPIWRNLNPILNRLLPIKSIPACLAVGILWGWLPCGLVYSASLYALGSGSAATGGLYMLAFALGTLPNLXAIGIFSLQLXKIMQNRYIRLCTGLSVSLWALWKLAVLWL

SEQ ID NO: 230 - protein, 222 aa, Neisseria
MNHDITFLTLFLLGFFGGTHCIGMCGGLSSAFALQLPPHINRFWLILLLNTGRISSYTAIGLMLGLIGQLGISLDQTRVLQNILYTASNLLLLFLGLYLSGISSLAAKIEKIGKPIWRNLNPILNRLLPIKSIPACLAVGILWGWLPCGLVYSASLYALGSGSATTGGLYMLAFALGTLPNLLAIGIFSLQLKKIMQNRYIRLCTGLSVSLWALWKLAVLWL

SEQ ID NO: 231 - protein, 277 aa, Neisseria
  VARIANT (1)...(277): Xaa = Any Amino Acid
MENQRPLLGFRLALLAAMTWGTLPXSVRQVLKFVDAPTLVWVRFTVAAAVLFVLLALGGRLPKRRDFSWCSFRLLLLGVAGISANFVLIAQGLHYISPTTTQVLWQISPFTMIVVGVLVFKDRMTAAQKIGLVLLLAGLLMYFNDKFGELSGLGAYXKGVLLCAAGSMAWVCNAVAQKLLSAQFGPQQILLLIYAASAAVFLPFAEPAHIGSMDGTLAWVCIAYCCLNTLIGYGSFGEALKHWEASKVSAVTTLLPVFTVINTLLGHYVMPETFAAP

SEQ ID NO: 232 - protein, 277 aa, Neisseria
  VARIANT (1)...(277): Xaa = Any Amino Acid
MENQRPLLGFALALLAAMTWGTLPIAVRQVLKFVDAPTLVWVRFTVAAAVLFVLLALGGRLPKRRDFSWCSFRLLLLGVAGISANFVLIAQGLHYISPTTTQVLWQISPFTMIVVGVLVFKDRMTAAQKIGLVLLLAGLLMFFNDKFGELSGLGAYAKGVLLCAAGSMAWVCYAVAQKLLSAQFGPQQILLLIYAASAAVFLPFAEPAHIGSLDGTLAWVCFAYCCLNTLIGYGSFGEALKHWEASKVSAVTTLLPVFTVIXXLLGHYVMPETFAAP

SEQ ID NO: 233 - protein, 307 aa, Neisseria
MENQRPLLGFALALLAAMTWGTLPIAVRQVLKFVDAPTLVWVRFTVAAAVLFVLLALGGRLPKWRDFSWCSFRLLLLGVAGISANFVLIAQGLHYISPTTTQVLWQISPFTMIVVGVLVFKDRMTAAQKIGLVLLLAGLLMFFNDKFGELSGLGAYAKGVLLCAAGSMAWVCYAVAQKLLSAQFGPQQILLLIYAASAAVFLPFAELAHIGSLDGTLAWVCFAYCCLNTLIGYGSFGEALKHWEASKVSAVTTLLPVFTVIFSLLGHYVMPDTFAAPDMNGLGYAGALVVVGGAVTAAVGDRLFKRR

SEQ ID NO: 234 - protein, 307 aa, Neisseria
  VARIANT (1)...(307): Xaa = Any Amino Acid
MENQRPLLGFALALLAAMTWGTLPIAVRQVLKFVDAPTLVWVRFTVAAAVLFVLLALGGRLPKRRDFSWHSFRLLLLGVTGISANFVLIAQGLHYISPTTTQVLWQISPFTMIVVGVLVFKDRMTAAQKIGLVLLLVGLLMFFNDKFGELSGLGAYAKGVLLCAAGSMAWVCYAVAQKLLSAQFGPQQILLLIYAASAAVFLLXAEPAHIGSLDGTLAWVCFVYCCLNTLIGYGSFGEALKHWEASKVSAVTTLLPVFTVIFSLLGHYVMPDTFAAPDMNGLGYVGALVVVGGAVTAAVGDRPFKRR

SEQ ID NO: 235 - protein, 307 aa, Neisseria
MENQRPLLGFALALLAAMTWGTLPIAVRQVLKFVDAPTLVWVRFTVAAAVLFVLLALGGRLPKRRDFSWHSFRLLLLGVTGISANFVLIAQGLHYISPTTTQVLWQISPFTMIVVGVLVFKDRMTAAQKIGLVLLLVGLLMFFNDKFGELSGLGAYAKGVLLCAAGSMAWVCYAVAQKLLSAQFGPQQILLLIYAASAAVFLPFAEPAHIGSLDGTLAWVCFVYCCLNTLIGYGSFGEALKHWEASKVSAVTTLLPVFTVIFSLLGHYVMPDTFAAPDMNGLGYVGALVVVGGAVTAAVGDRPFKRR

SEQ ID NO: 236 - protein, 312 aa, Neisseria
  VARIANT (1)...(312): Xaa = Any Amino Acid
MVARRAHNPKVVGSNPXPATXFQTPRFNAEXVLXLPVSCFLFPAASVFCRIFLPAAISERQTAVCLRLQIQAVWLQSSALSSRKPTMPTVRFTESVSKQDLDALFEWAKASYGAESCWKTLYLNGXPLGNLSPEWVERVXKDWEAGCXESSDGIFLNADGWPDMGGRLQHLALGWHCAGLLDGWRNECFDLTDGGGNPLFTLERAXXRPXGLLSRAVHLNGLTESDGRWHFWIGRRSPHKAVDPNKLDNTXAGGVSGGEMPSEAVCRESSEEAGLDKTLLPLIRPVSQLHSLRSVSRGVHNEILYVFDAVLP

SEQ ID NO: 237 - protein, 291 aa, Neisseria
MPTVRFTESVSKQDLDALFEWAKASYGAESCWKTLYLNGLPLGNLSPEWVERVKKDWEAGCSESSDGIFLNADGWPDMGGRLQHLALGWHCAGLLDGWRNECFDLTDGGGNPLFTLERAAFRPFGLLSRAVHLNGLTESDGRWHFWIGRRSPHKAVDPNKLDNTAAGGVSGGEMPSEAVCRESSEEAGLDKTLLPLIRPVSQLHSLRSVSRGVHNEILYVFDAVLPETFLPENQDGEVAGFEKMDIGGLLDAMLSGNMMHDAQLVTLDAFCRYGLIDAAHPLSEWLDGIRL

SEQ ID NO: 238 - protein, 291 aa, Neisseria
MPTVRFTESVSKHDLDALFEWAKASYGAESCWKTLYLNGLPLGNLSPEWAERVKKDWEAGCSESSDGIFLNADGWPDMGRRLQHLARIWKEAGLLHGWRDECFDLTDGGSNPLFALERAAFRPFGLLSRAVHLNGLVESDGRWHFWIGRRSPHKAVDPDKLDNTAAGGVSSGELPSETVCRESSEEAGLDKTLLPLIRPVSQLHSLRPVSRGVHNEILYVFDAVLPETFLPENQDGEVAGFEKMDIGGLLAAMLSGNMMHDAQLVTLDAFCRYGLIDAAHPLSEWLDGIRL

SEQ ID NO: 239 - protein, 372 aa, Neisseria
MVARRAHNPKVVGSNPAPATKYQTPRFNAEGVLFFLFPAASVFCRIFLPAAISERQAAVCLRLQIQAVWLQSSALCSRKPAMPTVRFTESVSKQDLDALFERAKASYGAESCWKTLYLNRLPLGNLSPEWAERIKKDWEAGCSESSNGIFLNADGWPDMGGRLQHLARTWNKAGLLHGWRNECFDLTDGGGNPLFTLERAAFRPFGLLIRAVHLNGLVESNGRWHFWIGRRSPHKAVDPGKLDNIAGGGVSGGEMPSEAVCRESSEEAGLDKTLFPLIRPVSRLHSLRPVSRGVHNEILYVFDAVLPETFLPENQDGEVAGFEKMDIGGLLDAMLSKNMMHDAQLVTLDAFYRYGLIDAAHPLSEWLDGIRL

SEQ ID NO: 240 - protein, 291 aa, Neisseria
MPTVRFTESVSKQDLDALFERAKASYGAESCWKTLYLNRLPLGNLSPEWAERIKKDWEAGCSESSDGIFLNADGWPDMGGRLQHLARTWNKAGLLHGWRNECFDLTDGGGNPLFTLERAAFRPFGLLSRAVHLNGLVESNGRWHFWIGRRSPHKAVDPGKLDNIAGGGVSGGEMPSEAVCRESSEEAGLDKTLFPLIRPVSRLHSLRPVSRGVHNEILYVFDAVLPETFLPENQDGEVAGFEKMDIGGLLDAMLSKNMMHDAQLVTLDAFYRYGLIDAAHPLSEWLDGIRL

SEQ ID NO: 241 - protein, 188 aa, Neisseria
  VARIANT (1)...(188): Xaa = Any Amino Acid
MNRPKQPFFRPEVAVARQTSLTGKVILTRPLSFSLWTTFASISALLIILFLIFGNYTRKTTVEGQILPASGVIRVYAPDTXTITAKFVEDGXKVKAGDKLFALSTSRFGAGGSVQQQLKTEAVLKKTLAEQELGRLKLIHGNETRSLKATVERLENQELHISQQIDGQKRRIRLAEEMLQKYRFLSXQ

SEQ ID NO: 242 - protein, 238 aa, Neisseria
  VARIANT (1)...(238): Xaa = Any Amino Acid
MNRPKQPFFRPEVAVARQTSLTGKVILTRPLSFSLWTTFASISALLIILFLIFGNYTRKTTVEGQILPASGVIRVYAPDTGTITAKFXEDGEKVKAGDKLFALSTSRFGAGDSVQQQLKTEAVLKKTLAEQELGRLKLIHGNETRSLKATVERLENQELHISQQIDGQKRRIRLAEEMLQKYRFLSANDAVPKQEMMNVKAELLEQKAKLDAYRREEVGLLQEIRTQNLTLXSLPQAA

SEQ ID NO: 243 - protein, 188 aa, Neisseria
MNRPKQPFFRPEVAIARQTSLTGKVILTRPLSFSLWTTFASISALLIILFLIFGNYTRKTTMEGQILPASGVIRVYAPDTGTITAKFVEDGEKVKAGDKLFALSTSRFGAGGSVQQQLKTEAVLKKTLAEQELGRLKLIHENETRSLKATVERLENQKLHISQQIDGQKRRIRLAEEMLRKYRFLSAQ

SEQ ID NO: 244 - protein, 181 aa, Neisseria
  VARIANT (1)...(181): Xaa = Any Amino Acid
MLNTFFAVLGGCLLXLPCGKSVNTAVQPQNAVQSAPKPVFKVIYIDNTAIAGLDLGQSSEGKTNDGKKQISYPIKGLPEQNVIRLIGKHPGDLEAVSGKCMETDDKDSPAGWAENGVCHTLFAKLVGNIAEDGGKLTDYLVSHAALQPYQAGKSGYAAVQNGRYVLEIDSEGAFYFRRRHY

SEQ ID NO: 245 - protein, 181 aa, Neisseria
MLKTSFAVLGGCLLLAACGKSENTAEQPQNAVQSAPKPVFKVKYIDNTAIAGLDLGQSSEGKTNDGKKQISYPIKGLPEQNVIRLIGKHPGDLEAVSGKCMETDDKDSPAGWAENGVCHTLFAKLVGNIAEDGGKLTDYLVSHAALQPYQAGKSGYAAVQNGRYVLEIDSEGAFYFRRRHY

SEQ ID NO: 246 - protein, 181 aa, Neisseria
MLKIPFAVLGGCLLLAACGKSENTAEQPQNAAQSAPKPVFKVKYIDNTAIAGLALGQSSEGKTNDGKKQISYPIKGLPEQNAVRLTGKHPNDLEAVVGKCMETDGKDAPSGWAENGVCHTLFAKLVGNIAEDGGKLTDYLISHSALQPYQAGKSGYAAVQNGRYVLEIDSEGAFYFRRRHY

SEQ ID NO: 247 - protein, 231 aa, Neisseria
  VARIANT (1)...(231): Xaa = Any Amino Acid
MEDLYIILALGLVAMIAGFIDAIAGGGGLITLPALLLAGIPPVSAIATNKLQAAAATFSATVSFARKGLIDWKKGLPIAAASFVGGVAGALSVSLVSKDILLAVVPVLLIFVALYFVFSPKLDGSKEGKARMSFFLFGLTVXTAFGFLRRCVRTGCRLVFSDCLYCFARLQAVERDVLHQIGERCLQSWFAIGIPAARFDYFPDCGNDGGRCVCRCEFRCEICRTLRFEAD

SEQ ID NO: 248 - protein, 262 aa, Neisseria
MEDLYIILALGLVAMIAGFIDAIAGGGGLITLPALLLAGIPPVSAIATNKLQAAAATFSATVSFARKGLIDWKKGLPIAAASFVGGVAGALSVSLVSKDILLAVVPVLLIFVALYFVFSPKLDGSKEGKARMSFFLFGLTVAPLLGFYDGVFGPGVGSFFLIAFIVLLGCKLLNAMSYTKLANVACNLGSLSVFLLHGSIIFPIAATMAVGAFVGANLGARFAVRFGSKLIKPLLIVISISMAVKLLIDERNPLYQMIVSMF

SEQ ID NO: 249 - protein, 262 aa, Neisseria
MEDLYIILALGLVAMIAGFIDAIAGGGGLITLPALLLAGIPPVSAIATNKLQAAAATFSATVSFARKGLIDWKKGLPIAAASFAGGVVGALSVSLVSKDILLAVVPVLLIFVALYFVFSPKLDGSKEGKARMSFFLFGLTVAPLLGFYDGVFGPGVGSFFLIAFIVLLGCKLLNAMSYTKLANVACNLGSLSVFLLHGSIIFPIAATMAVGAFVGANLGARFAVRFGSKLIKPLLIVISISMAVKLLIDERNPLYQMIVSMF

SEQ ID NO: 250 - protein, 231 aa, Neisseria
MEDLYIILALGLVAMIAGFIDAIAGGGGLITLPALLLAGIPPVSAIATNKLQAAAATFSATVSFARKGLIDWKKGLPIAAASFAGGVVGALSVSLVSKDILLAVVPVLLIFVALYFVFSPKLDGSKEGKARMSFFLFGLTVATAFGFLRRCVRTGCRLVFSDCLYCFARLQAVERDVLHQIGERCLQSWFAIGIPAARFDYFPDCGNDGGRCVCRCEFRCEICRPLRFEAD

SEQ ID NO: 251 - protein, 262 aa, Neisseria
MEDLYIILALGLVAMIAGFIDAIAGGGGLITLPALLLAGIPPVSAIATNKLQAAAATFSATVSFARKGLIDWKKGLPIAAASFAGGVVGALSVSLVSKDILLAVVPVLLIFVALYFVFSPKLDGSKEGKARMSFFLFGLTVAPLLGFYDGVFGPGVGSFFLIAFIVLLGCKLLNAMSYTKLANVACNLGSLSVFLLHGSIIFPIVATMAVGAFVGANLGARFAVRFGSKLIKPLLIVISISMAVKLLIDERNPLYQMIVSMF

SEQ ID NO: 252 - protein, 210 aa, Neisseria
  VARIANT (1)...(210): Xaa = Any Amino Acid
LLGIASVIGTLLQQNQPQTDYLVKFGSFWAXIFGFLGLYDVYASAWFVVIMMFLVVSTSLCLIRNVPPFWREMKSFREKVKEKSLAAMRHSSLLDVKIAPEVAKRYLEVQGFQGKTINREDGSVLIAAKKGTMNKWGYIFAHVALIVICLGGLIDSNLLLKLGMLTGRIFRTIRRFMPRIXKPESXFGCVQSLIGQRQYFXRGRVRMWFS

SEQ ID NO: 253 - protein, 241 aa, Neisseria
  VARIANT (1)...(241): Xaa = Any Amino Acid
MSKSRISPTLLSRPWFAFFSSMRFAVALLSLLGIASVIGTVLQQNQPQTDYLVKFGPFWTRIFDFLGLYDVYASAWFVVIMMFLVVSTSLCLIRNVPPFWREMKSFREKVKEKSLAAMRHSSLLDVKIAPEVAKRYLEVRGFQGKTVSREDGSVLIAAKKGTMNKWGYIXAHVALIVICLGRLINXNLLLKLGMLAGSIFRNNRRVMPRISKPESIWGGVQSLIKGQRQYFQRGKVRMWFS

SEQ ID NO: 254 - protein, 351 aa, Neisseria
MPSETRLPNFIRVLIFALGFIFLNACSEQTAQTVTLQGETMGTTYTVKYLSNNRDKLPSPAEIQKRIDDALKEVNRQMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 255 - protein, 351 aa, Neisseria
  VARIANT (1)...(351): Xaa = Any Amino Acid
MPSETRLPNFIRTLIFALSFIFLNACSEQTAQTVTLQGETMGTTYTVKYLSNNRDXLPSPAEIQXRIDDALKEVNRQMSTYQPDSEISRFNQHTAGKPLRISSDFAHVTAEAVHLNRLTHGALDVTVGPLVNLWGFGPDKSVTREPSPEQIKQAASYTGIDKIILKQGKDYASLSKTHPKAYLDLSSIAKGFGVDXVAGELEKYGIQNYLVEIGGELHGKXKNARGEPWRIGIEQPNIVQGGNTQIIVPLNNRSXATSGDYRIFHVDKSGKRLSHIINPNNKRPISHNLASISVXADSAMTADGXSTGLFVLGETEALKLAEREKLAVFLIVRDKGGYRTAMSSEFEKLLR

SEQ ID NO: 256 - protein, 351 aa, Neisseria
MPSETRLPNLIRALIFALGFIFLNACSEQTAQTVTLQGETMGTTYTVKYLSNNRDKLPSPAKIQKRIDDALKEVNRQMSTYQTDSEISRFNQHTAGKPLRISSDFAHVTAEAVRLNRLTHGALDVTVGPLVNLWGFGPDKSVTREPSPEQIKQAASYTGIDKIILQQGKDYASLSKTHPKAYLDLSSIAKGFGVDKVAGELEKYGIQNYLVEIGGELHGKGKNAHGEPWRIGIEQPNIIQGGNTQIIVPLNNRSLATSGDYRIFHVDKNGKRLSHIINPNNKRPISHNLASISVVSDSAMTADGLSTGLFVLGETEALRLAEQEKLAVFLIVRDKDGYRTAMSSEFAKLLR

SEQ ID NO: 257 - protein, 263 aa, Neisseria
  VARIANT (1)...(263): Xaa = Any Amino Acid
PCRRQGDDVYAAHASRQKLWLRFIGGRSHQNIRGGAAADGWRKGVQIGGEVFVRQNEGSXLAIGVMGGRAGQHASVNGKGGAAGSDLYGYGGGVYAAWHQLRDKQTGAYLDGWLQYQRFKHRINDENRAERYKTKGWTASVEGGYNALVAEGIVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMSA

SEQ ID NO: 258 - protein, 619 aa, Neisseria
MFRAQLGSNTRSTKIGDDADFSFSDKPKPGTSHYFSSGKTDQNSSEYGYDEINIQGKNYNSGILAVDNMPVVKKYITDTYGDNLKDAVKKQLQDLYKTRPEAWEENKKRTEEAYIEQLGPKFSILKQKNPDLINKLVEDSVLTPHSNTSQTSLNNIFNKKLHVKIENKSHVAGQVLELTKMTLKDSLWEPRRHSDIHMLETSDNARIRLNTKDEKLTVHKAYQGGADFLFGYDVRESDKPALTFEEKVSGQSGVVLERRPENLKTLDGRKLIAAEKADSNSFAFKQNYRQGLYELLLKQCEGGFCLGVQRLAIPEAEAVLYAQQAYAANTLFGLRAADRGDDVYAADPSRQKLWLRFIGGRSHQNIRGGAAADGRRKGVQIGGEVFVRQNEGSRLAIGVMGGRAGQHASVNGKGGAAGSYLHGYGGGVYAAWHQLRDKQTGAYLDGWLQYQRFKHRINDENRAERYKTKGWTASVEGGYNALVAEGVVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMSARIGYGKRTDGDKEAALSLKWLF

SEQ ID NO: 259 - protein, 627 aa, Neisseria
KKLRDRNSEYWKEETYHIKSNGRTYPNIPALFPKHPFDPFENINNSKKISFYDKEYTEDYLVGFARGFGVEKRNGEEEKPLRQYFKDCVNTENSNNDNCKISSFGNYGPILIKSDIFALASQIKNSHINSEILSVGNYIEWLRPTLNKLTGWQEHLYAGLDPFHYIEVTDNSHVIGQTIDLGALELTNSLWKPRWNSNIDYLITKNAEIRFNTKNESLLVKEDYAGGARFRFAYDLKDKVPEIPVLTFEKNITGTSDIIFEGKALDNLKHLDGHQIVKVNDTADKDAFRLSSKYRKGIYTLSLQQRPEGFFTKVQERDDIAIYAQQAQAANTLFALRLNDKNSDIFDRTLPRKGLWLRVIDGHSNQWVQGKTAPVEGYRKGVQLGGEVFTWQNESNQLSIGLMGGQAEQRSTFRNPDTDNLTTGNVKGFGAGVYATWHQLQDKQTGAYVDSWMQYQRFRHRINTEYATERFTSKGITASIEAGYNALLAEHFTKKGNSLRVYLQPQAQLTYLGVNGKFSDSENAQVNLLGSRQLQSRVGVQAKAQFAFTNGVTFQPFVAVNSIYQQKPFGVEIDGDRRVINNKTVIETQLGVAAKIKSHLTLQASFNRQTSKHHHAKQGALNLQWTF

SEQ ID NO: 260 - protein, 127 aa, Neisseria
  VARIANT (1)...(127): Xaa = Any Amino Acid
AEYVQFSIDLFSVGKSGGGIPKAKPVFDAKPRWEVDRKLNKLTTREQVEKNVQETRRRSQSSQFKAHAQREWENKTGLDFNHFIGGDINKKGTVTGGHSLTRGDVRVIQQTSAPDKHGXLSSDSGNX

SEQ ID NO: 261 - protein, 227 aa, Neisseria
  VARIANT (1)...(227): Xaa = Any Amino Acid
AVCLPMHAHASXLANDSFIRQVLDRQHFEPDGKYHLFGSRGELAERQSHIGLGKIQSHQLGNLMIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLADRFHNAGSMLTQGVGDGFKRATRYSPELDRSGNAAEAFNGTADIVKNIIGAAGEI

SEQ ID NO: 262 - protein, 298 aa, Neisseria
  VARIANT (1)...(298): Xaa = Any Amino Acid
RRLKHCCHARLGSAFHRKQDGAHQRFGRYGATQRLCRSSHPRLGSPKPQCRTRHRSRQQYLYGSHPHQRDWSCPGKIQLGRHHGTSCRAVADXRDRICEREIRRQRQXCRCRLGKIPSLSIPKYPLKLEQRYGKENITSSTVPPSNGKNVKLADQRHPKTGVPFDGKGFPNFEKHVKYDTKLDIQELSGGGIPKAKPVFDAKPRWEVDRKLNKLTTREQVEKNVQETRRRSQSSQFKAHAQREWENKTGLDFNHFIGGDINKKGAVTGGHSLTRGDVRVIQQTSAPDKHGVLSSDSGN

SEQ ID NO: 263 - protein, 628 aa, Neisseria
  VARIANT (1)...(628): Xaa = Any Amino Acid
LGISRKISLILSILAVCLPMHAHASDLANDPFIRQVLDRQHFEPDGKYHLFGSRGELAXRNGHIGLGNIQSHQLGHLMIQQAAVEGNIGYIVRFSDHGHKFHSPFDNHASHSDSDEAGSPVDGFSLYRIHWDGYEHHPADGYDGPQGGGYPAPKGARDIYSYDIKGVAQNIRLNLTDNRSTGQRLADRFHNAGAMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFMAAIPIKGIGAVRGKYGLGGITAHPVKRSQMGAIALPKGKSAVSDNFADAAYAKYPSPYHSRNIRSNLEQRYGKENITSSTVPPSNGKNVKLADQRHPKTGVPFDGKGFPNFEKHVKYDTKLDIQELSGGGIPKAKPVFDAKPRWEVDRKLNKLTTREQVEKNVQETRRRSQSSQFKAHAQREWENKTGLDFNHFIGGDINKKGTVTGGHSLTRGDVRVIQQTSAPDKHGVYQATVEIKKPDGSWEVKTKKGGKVMTKHTMFPKDWDEARIRAEVTSAWESRIMLKDNKWQGTSKSGIKIEGFTEPNRTAYPIYE

SEQ ID NO: 264 - protein, 556 aa, Neisseria
LGISRKISLILSILAVCLPMHAHASDLANDSFIRQVLDRQHFEPDGKYHLFGSRGELAERSGHIGLGNIQSHQLGNLFIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLVDRFHNTGSMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFTAVIPVKGIGAVRGKYGLGGITAHPVKRSQMGEIALPKGKSAVSDNFADAAYAKYPSPYHSRNIRSNLEQRYGKENITSSTVPPSNGKNVKLANKRHPKTKVPFDGKGFPNFEKDVKYDTRINTAVPQVNPIDEPVFNPKGSVGSAHSWSITARIQYAKLPRQGRIRYIPPKNYSPSAPLPKGPNNGYLDKFGNEWTKGPSRTKGQEFEWDVQLSKTGREQLGWASRDGKHLNISIDGKITHK

SEQ ID NO: 265 - protein, 119 aa, Neisseria
MNIHTLLSKQWTLPPFLPKRLLLSLLILLAPNAVFWVLALLTATARPIVNLDYLPAALLIALPWRFVKIAGVLAFWLAVLFDGLMMVIQLFPFMDLIGAINLVPFILTAPAPYQIMTGL

SEQ ID NO: 266 - protein, 472 aa, Neisseria
MNIHTLLSKQWTLPPFLPKRLLLSLLILLAPNAVFWVLALLTATARPIVNLDYLPAALLIALPWRFVKIAGVLAFWLAVLFDGLMMVIQLFPFMDLIGAINLVPFILTAPAPYQIMTGLLLLYMLAMPFVLQKAAAKTDFRHIAVCAAVVAAAGYFTGHLSYYDRGRMANIFGANNFYYAKSQAMLYTVSQNADFITAGLVDPVFLPLGNQQRAATHLNEPKSQKILFIVAESWGLPANPELQNATFAKLLAQKDRFSVWESGSFPFIGATVEGEMRELCAYGGLRGFALRRAPDEKFARCLPNRLKQEGYATFAMHGAGSSLYDRFSWYPRAGFQEIKTAENLIGKKTCAIFGGVCDSELFGEVSAFFKKHDKGLFYWMTLTSHADYPESDIFNHRLKCTEYGLPAETDLCRNFSLHTQFFDQLADLIQRPEMKGTEVIIVGDHPPPVGNLNETFRYLKQGHVAWLNFKIK

SEQ ID NO: 267 - protein, 472 aa, Neisseria
  VARIANT (1)...(472): Xaa = Any Amino Acid
MNIHTLLSKQWTLPPFLPKRLLLSLLILLXPNAVFWVLALLTATARPIVNLXYLPAALLIALPWRXVKIXGVLAXWLAVLFDGLMMVIQLFPFMDLIGAINLVPFIXTAPALYQIMTGLLLLYMLAMPFVLQKAAAKTDFRHIAACAAVVVAAGYFTGHLSXYDRGRMANIFGANNFYYAKSQAMLYTVSQNADFITAGLVDPVFLPLGNQQRAATHLNEPKSQKILFIVAESWGLPANPELQNATFAKLLAQKXRFSVWESGSFPFIGATIEGEMRELCAYGGLRGFALRRAPDEKFARCLPNRLKQEGYATFAMHGAGSSLYDRFSWYPRAGFQEIKTAENLIGKKTCAIFGGVCDSELFGEVSAXFKKHDKGLFYWMTLTSHADYPESDIFNHRLKCTEYGLPAETDXCRNFSLHTQFFDQLADLIQRPEMKGTEVIIVGDHPPPVGNLNETFRYLKQGHVXWLNFKIK

SEQ ID NO: 268 - protein, 209 aa, Neisseria
MNIHALLSEQWTLPPFLPKRLLLSLLILLAPNAVFWVLALLTATARPIVNLDYLPAALLIALPWRFVKIAGVLAFWPAVLFDGLMMVIQLFPFMDLIGAINLVPFILTAPAPYQIMTGLLLLYMLAMPFVLQKAAVKTDFRHIAVCAAVVAAARYFTGPFELLRTGGRWQYVQHRRLLLSGSRASFRRRQKADVLRRLGNPYASMGNGG

SEQ ID NO: 269 - protein, 472 aa, Neisseria
MNIHALLSEQWTLPPFLPKRLLLSLLILLAPNAVFWVLALLTATARPIVNLDYLPAALLIALPWRFVKIAGVLAFWPAVLFDGLMMVIQLFPFMDLIGAINLVPFILTAPAPYQIMTGLLLLYMLAMPFVLQKAAVKTDFRHIAVCAAVVAAAGYFTGHLSYYDRGRMANIFGANNFYYAKSQAMLYTVSQNADFITAGLVDPVFLPLGNQQRAATRLSEPKSQKILFIVAESWGLPGNPELQNATFAKLLAQKDRFSVWESGSFPFIGATVEGEMRELCAYGGLRGFALRRAPDEKFARCLPNRLKQEGYATFAMHGAGSSLYDRFSWYPRAGFQKIKTAENLIGKKTCAIFGGVCDSELFGEVSAFFKKHDKGLFYWMTLTSHADYPESDIFNHRLKCTEYGLPAETDLCRNFSLHTQFFDQLADLIRRPEMKGTEVIIVGDHPPPVGNLNETFRYLKQGHVAWLHFKIK

SEQ ID NO: 270 - protein, 139 aa, Neisseria
  VARIANT (1)...(139): Xaa = Any Amino Acid
VSGRYRALDRVSKIIIVTLSIATLAAAGIAMSRGMQMQSDFIEPTPWTLAGLGFLIALMGWMPAPIEISAINSLWVTEKQRINPSEYRDGIFEFNVGYIASAVLALVFLALGXVAPNGNGXTVQMAGGKYNGQLINMYA

SEQ ID NO: 271 - protein, 417 aa, Neisseria
MSEQHISTWKSKINALGPGIMMASAAVGGSHLIASTQAGALYGWQIALIIILTNLFKYPFFRFSAHYTLDTGKSLIEGYAEKSRVYLWVFLILCILSATINAGAVAIVTAAIVKMAIPSLMFDAGTVAALIMASCLIILVSGRYRALDRVSKIIIVTLSIATLAAAGIAMSRGMQMQSDFIEPTPWTLAGLGFLIALMGWMPAPIEISAINSLWVTEKQRINPSEYRDGIFDFNVGYIASAVLALVFLALGAFVQYGNGEAVQMAGGKYIGQLINMYAVTIGGWSRPLVAFIAFACMYGTTITVVDGYARAIAEPVRLLRGKDKTGNAEFFAWNIWVAGSGLAVIFWFDGVMANLLKFAMIAAFVSAPVFAWLNYRLVKGDEKHKLTSGMNALALAGLIYLTGFTVLFLLNLAGMFK

SEQ ID NO: 272 - protein, 417 aa, Neisseria; identical to SEQ ID NO: 271

SEQ ID NO: 273 - protein, 269 aa, Neisseria
MPKKSCVYLWVFLILCIASATINAGAVAIVTAAIVKMAIPSLMFDAGTVAALIMASCLIILVSGRYRALDRVSKIIIVTLSIATLAAAGIAMSRGMQMQPDFIEPTPWTLAGLGFLIALMGWMPAPIEISAINSLWVTEKQRINPSEYRDGIFDFNVGYIASAVLALVFLALGAFVQYGNGEAVQMGGGKYIGQLINMYAVTIGGGSRPLVAFIAFACMYGAASTVVDGYARAIAEPVRLLRGKDKTARPIVLLEKLGGRHRFGRDFLV

SEQ ID NO: 274 - protein, 337 aa, Neisseria
KKSCVYLWVFLILCIASATINAGAVAIVTAAIVKMAIPSLMFDAGTVAALIMASCLIILVSGRYRALDRVSKIIIVTLSIATLAAAGIAMSRGMQMQPDFIEPTPWTLAGLGFLIALMGWMPAPIEISAINSLWVTEKQRINPSEYRDGIFDFNVGYIASAVLALVFLALGAFVQYGNGEAVQMAGGKYIGQLINMYAVTIGGWSRPLVAFIAFACMYGTTITVVDGYARAIAEPVRLLRGRDKTGNAELFAWNIWVAGSGLAVIFWFDGAMAELLKFAMIAAFVSAPVFAWLNYRLVKGDKRHRLTAGMNALAIVGLLYLAGFAVLFLLNLTGLLA

SEQ ID NO: 275 - protein, 103 aa, Neisseria
LRETAYVLDSFDRYFVVALAGLFFVRAQSEREWMREVSAWQEKKGEKQAELPEIKDGMPDFPELALMLFHAVKTAVYWLFVGVVRFCRNYLAHESEPDRPVPP

SEQ ID NO: 276 - protein, 1014 aa, Neisseria
MFWIVLIVILLLALAGLFFVRAQSEREWMREVSAWQEKKGEKQAELPEIKDGMPDFPELALMLFHAVKTAVYWLFVGVVRFCRNYLAHESEPDRPVPPASANRADVPTASDGYSDSGNGTEEAETEEAEAAEEEAADTEDIATAVIDNRRIPFDRSIAEGLMPSESEISPVRPVFKEITLEEATRALNSAALRETKKRYIDAFEKNETAVPKVRVSDTPMEGLQIIGLDDPVLQRTYSHMFDADKEAFSESADYGFEPYFEKQHPSAFSAVKAENARNAPFHRHAGQGKGQAEAKSPDVSQGQSVSDGTAVRDARRRVSVNLKEPNKATVSAEARISRLIPESQTVVGKRDVEMPSETENVFTETVSSVGYGGPVYDETADIHIEEPAAPDAWVVEPPEVPKVPMTAIDIQPPPPVSEIYNRTYEPPSGFEQVQRSRIAETDHLADDVLNGGWQEETAAIADDGSEGAAERSSGQYLSETEAFGHDSQAVCPFENVPSERPSCRVSDTEADEGAFPSEETGAVSEHLPTTDLLLPPLFNPEATQTEEELLENSITIEEKLAEFKVKVKVVDSYSGPVITRYEIEPDVGVRGNSVLNLEKDLARSLGVASIRVVETIPGKTCMGLELPNPKRQMIRLSEIFNSPEFAESKSKLTLALGQDITGQPVVTDLGKAPHLLVAGTTGSGKSVGVNAMILSMLFKAAPEDVRMIMIDPKMLELSIYEGIPHLLAPVVTDMKLAANALNWCVNEMEKRYRLMSFMGVRNLAGFNQKIAEAAARGEKIGNPFSLTPDDPEPLEKLPFIVVVVDEFADLMMTAGKKIEELIARLAQKARAAGIHLILATQRPSVDVITGLIKANIPTRIAFQVSSKIDSRTILDQMGAENLLGQGDMLFLLPGTAYPQRVHGAFASDEEVHRVVEYLKQFGEPDYVDDILSGGGSEELPGIGRSGDDETDPMYDEAVSVVLKTRKASISGVQRALRIGYNRAARLIDQMEAEGIVSAPEHNGNRTILVPLDNA

SEQ ID NO: 277 - protein, 1014 aa, Neisseria
  VARIANT (1)...(1014): Xaa = Any Amino Acid
MFWIVLIVILLLALAGLFFVRAQSEREWMREVSAWQEKKGEKQAELPEIKDGMPDFPELALMLFHAVKTAVYWLFVGVVRFCRNYLAHESEPDRPVPPASANRADVPTASDGYSDSGNGTEEAETEEAEAAEEEAADTEDIATAVIDNRRIPFDRSIAEGLMPSESEISPVRPVFKEITLEEATRALNSAALRETKKRYIDAFEKNETAVPKVRVSDTPMEGLQIIGLDDPVLQRTYSRMFDADKEAFSESADYGFEPYFEKQHPSAFSAVKAENARNAPFRRHAGQGKGQAEAKSPDVSQGQSVSDGTAVRDAXRRVSVNLKEPNKATVSAEARISRLIPESRTVVGKRDVEMPSETENVFTEXVSSVGYGXPVYDETADIHIEEPAAPDAWVVEPPEVPKVPMPAXDIPPPPPVSEIYNRTYEPPAGFEQVQRSRIAETDHLADDVLNGGWQEETAAIANDGSEGVAERSSGQYLSETEAFGHDSQAVCPFENVPSERPSRRAXDTEADEGAFQSEETGAVSEHLPTTDLLLPPLFNPGATQTEEXLLXNSITIEEKXAEFKVKVKVVDSYSGPVITRYEIEPDVGVRGNSVLNLEKXLARSLGVASIRVVETILGKTCMGLELPNPKRQMIRLSEIFNSPEFAESKSKLTLALGQDITGQPVVTDLGKAPHLLVAGTTGSGKSVGVNAMILSMLFKAAPEDVRMIMIDPKMLELSIYEGIPHLLAPVVTDMKLAANALNWCVNEMEKRYRLMSFMGVRNLAGXNQKIAEAAARGEKIGNPFSLTPDNPEPLXKLPFIVVVVDEFADLMMTAGKKIEELIARLAQKARAAGIHLILATQRPSVDVITGLIKANIPTRIAFQVSSKIDSRTILDQMGAENLLGQGDMLFLPPGTAYPQRVHGAFASDEEVHRVVEYLKQFGEPDYVDDXLSGGMSDDLLGISRSGDGETDPMYDEAVSVVLKTRKASISGVQRALRIGYNRAARLIDQMEAEGIVSAPEHNGNRTILVPXDNA

SEQ ID NO: 278 - protein, 925 aa, Neisseria
SEPDRPVPPASANRADVPTASDGYSDSGNGTEEAETEAAEAAEEEAADTEDIATAVIDNRRIPFDRSIAEGLMQSESKTSPVRPVFKEITLEEATRALSSAALRETKKRYIDAFEKNGTAVPKVRVSDTPMEGLQIIGLDDPVLQRTYSRMFDADKEAFSESADYGFEPYFEKQHPSAFSAVKAENARNAPFRRHAGQEKGQAEAKSPDVSQGQSVSDGTAVRDARRRVSVNLKEPNKATVSAEARISRLIPESRTVVGKRDVEMPSETENVFTETVSSVGYGGPVYDEAADIHIEEPAAPDAWVVEPPEVPEVAVPEIDILPPPPVSEIYNRTYEPPAGFEQAQRSRIAETDHLAADVLNGGWQEETAAIADDGSEGAAERSSGQYLSETEAFGHDSQAVCPFEDVPSERPSCRVSDTEADEGAFQSEETGAVSEHLPTTDLLLPPLFNPEATQTEEELLENSITIEEKLAEFKVKVKVVDSYSGPVITRYEIEPDVGVRGNSVLNLEKDLARSLGVASIRVVETIPGKTCMGLELPNPKRQMIRLSEIFNSPEFAESKSKLTLALGQDITGQPVVTDLGKAPHLLVAGTTGSGKSVGVNAMILSMLFKAAPEDVRMIMIDPKMLELSIYEGITHLLAPVVTDMKLAANALNWCVNEMEKRYRLMSFMGVRNLAGFNQKIAEAAARGEKIGNPFSLTPDDPEPLEKLPFIVVVVDEFADLMMTAGKKIEELIARLAQKARAAGIHLILATQRPSVDVITGLIKANIPTRIAFQVSSKIDSRTILDQMGAENLLGQGDMLFLPPGTAYPQRVHGAFASDEEVHRVVEYLKQFGEPDYVDDILSGGGSEELPGIGRSGDGETDPMYDEAVSVVLKTRKASISGVQRALRIGYNRAARLIDQMEAEGIVSAPEHNGNRTILVPLDNA

SEQ ID NO: 279 - protein, 1014 aa, Neisseria
MFWIVLIVIVLLALAGLFFVRAQSEREWMREVSAWQEKKGEKQAELPEIKDGMPDFPEFSLMLFHAVKTAVYWLFVGVVRFCRNYLAHESEPDRPVPPASANRADVPTASDGYSDSGNGTEEAETEAAEAAEEEAADTEDIATAVIDNRRIPFDRSIAEGLMQSESKTSPVRPVFKEITLEEATRALSSAALRETKKRYIDAFEKNGTAVPKVRVSDTPMEGLQIIGLDDPVLQRTYSRMFDADKEAFSESADYGFEPYFEKQHPSAFSAVKAENARNAPFRRHAGQEKGQAEAKSPDVSQGQSVSDGTAVRDARRRVSVNLKEPNKATVSAEARISRLIPESRTVVGKRDVEMPSETENVFTETVSSVGYGGPVYDEAADIHIEEPAAPDAWVVEPPEVPEVAVPEIDILPPPPVSEIYNRTYEPPAGFEQAQRSRIAETDHLAADVLNGGWQEETAAIADDGSEGAAERSSGQYLSETEAFGHDSQAVCPFEDVPSERPSCRVSDTEADEGAFQSEETGAVSEHLPTTDLLLPPLFNPEATQTEEELLENSITIEEKLAEFKVKVKVVDSYSGPVITRYEIEPDVGVRGNSVLNLEKDLARSLGVASIRVVETIPGKTCMGLELPNPKRQMIRLSEIFNSPEFAESKSKLTLALGQDITGQPVVTDLGKAPHLLVAGTTGSGKSVGVNAMILSMLFKAAPEDVRMIMIDPKMLELSIYEGITHLLAPVVTDMKLAANALNWCVNEMEKRYRLMSFMGVRNLAGFNQKIAEAAARGEKIGNPFSLTPDDPEPLEKLPFIVVVVDEFADLMMTAGKKIEELIARLAQKARAAGIHLILATQRPSVDVITGLIKANIPTRIAFQVSSKIDSRTILDQMGAENLLGQGDMLFLPPGTAYPQRVHGAFASDEEVHRVVEYLKQFGEPDYVDDILSGGGSEELPGIGRSGDGETDPMYDEAVSVVLKTRKASISGVQRALRIGYNRAARLIDQMEAEGIVSAPEHNGNRTILVPLDNA

SEQ ID NO: 280 - protein, 373 aa, Neisseria
  VARIANT (1)...(373): Xaa = Any Amino Acid
MIYQRNLIKELSFTAVGIFVVLLAVLVSTQAINLLGRAADGXVIAIDAVLALVGFWVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIAIGLFLIYQNGLTLLFEAVEDGKIHFWLGLLPMHIIMFVLALILLRVRSMPSQPFWQAVGKSLTLKGGK

SEQ ID NO: 281 - protein, 371 aa, Neisseria
MIYQRNLIKELSFTAVGIFVVLLAVLVSTQAINLLGRAADGRVAIDAVLALVGFWVIGMTPLLLVLTAFISTLTVLTRYWRDSEMSVWLSCGLALKQWIRPVMQFAVPFAVLVAVMQLWVIPWAELRSREYAEILKQKQELSLVEAGEFNSLGKRNGRVYFVETFDTESGIMKNLFLREQDKNGGDNIIFAKEGNFSLNDNKRTLELRHGYRYSGTPGRADYNQVSFQKLNLIISTTPKLIDPVSHRRTIPTAQLIGSSNPQHQAELMWRISLTVSVLLLCLLAVPLSYFNPRSGHTYNILIAIGLFLIYQNGLTLLFEAVEDGKIHFWLGLLPMHIIMFAVALILLRVRSMPSQPFWQAVGKSLTLKGGK

SEQ ID NO: 282 - protein, 371 aa, Neisseria
  VARIANT (1)...(371): Xaa = Any Amino Acid
MIYQRNLIKELSFTAVGIFVVLLAVLVSTQAINLLGXAADXRXAIDAVLALVGFWVXXMTPLLLVLTAFISTLTVLTRYWRDSEMSVWXSCGLALKQWIRPVMQFAVPFAVLVAVMQLWVIPWAELRSREYAEILKQKQELSLVEAGGFNSLGKRNGRVYFVETFDTESGIMKNLFLREQDKNGGDNIIFXKESNFSLNDNKRTLELRHGYRYSGTPGRADYNQVSFXKLNLIISTTPKLIDPVSHRRTXPTAQLIGSSNPQHXAELMWRISLTVSVLLLCLLAVPLSYFNPRSGHTYNILXAIGLFLIYQNGLTLLFEAVEDGKIHFWLGLLPMHIIMFVIAIVLLRVRSMPSQPFWQAVGKSLTLKGGK

SEQ ID NO: 283 - protein, 362 aa, Neisseria
MIYQRNLIKELSFTAVGIFVVLLAVLVSTQAINLLGRAADGRVAIDAVLALVGFWVIGMTPLLLVLTAFISTLTVLTRYWRDSEMSVWLSCGLALKQWIRPVMQFAVPFAILIAVMQLWVIPWAELRSREYAEILKQKQELSLVEAGEFNNLGKRNGRVYFVETFDTESGIMKNLFLREQDKNGGDNIIFAKEGNFSLKDNKRTLELRHGYRYSGTPGRADYNQVSFQKLNLIISTTPKLIDPVSHRRTISTAQLIGSSNPQHQAELMWRISLTVSVLLLCLLAVPLSYFNPRSGHTYNILIAIGLFLIYQNGLTLLFEAVEDGKIHFWLGLLPMHIIMFVIAIVLLRVRSMPSQPFWQAVG

SEQ ID NO: 284 - protein, 371 aa, Neisseria
MIYQRNLIKELSFTAVGIFVVLLAVLVSTQAINLLGRAADGRVAIDAVLALVGFWVIGMTPLLLVLTAFISTLTVLTRYWRDSEMSVWLSCGLALKQWIRPVMQFAVPFAILIAVMQLWVIPWAELRSREYAEILKQKQELSLVEAGEFNNLGKRNGRVYFVETFDTESGIMKNLFLREQDKNGGDNIIFAKEGNFSLKDNKRTLELRHGYRYSGTPGRADYNQVSFQKLNLIISTTPKLIDPVSHRRTISTAQLIGSSNPQHQAELMWRISLTVSVLLLCLLAVPLSYFNPRSGHTYNILIAIGLFLIYQNGLTLLFEAVEDGKIHFWLGLLPMHIIMFVIAIVLLRVRSMPSQPFWQAVGKSLTLKGGK

SEQ ID NO: 285 - protein, 135 aa, Neisseria
  VARIANT (1)...(135): Xaa = Any Amino Acid
GGGFINASCATLTTAKPQYQAGDLSAFKIRQGNVVIAGHGLDARDTDYTRILSYHSKIDAPVWGQDVRVVAGQNDVAATGDAHSPILNNAAANTSNNTANNGTHIPLFAIDTGKLGGXVCQQNHLDQYGRASRHS

SEQ ID NO: 286 - protein, 263 aa, Neisseria; identical to SEQ ID NO: 124

SEQ ID NO: 287 - protein, 325 aa, Neisseria
STGHSEQNYTLPREITRNISLGSFAYESHRKALSHHAPSQGTELPQSNGISLPYTSNSFTPLPSSSLYIINPVNKGYLVETDPRFANYRQWLGSDYMLDSLKLDPNNLHKRLGDGYYEQRLINEQIAELTGHRRLDGYQNDEEQFKALMDNGATAARSMNLSVGIALSAEQVAQLTSDIVWLVQKEVKLPDGGTQTVLVPQVYVRVKNGDIDGKGALLSGSNTQINVSGSLKNSGTIAGRNALIINTDTLDNIGGRIHAQKSAVTATQDINNIGGMLSAEQTLLLNAGNNINSQSTTASSQNTQGSSTYLDRMAGIYITGKEKGV

SEQ ID NO: 288 - protein, 721 aa, Neisseria
MLVQTEKDGLHNEQTFGEKKVFSENGKLHNYWRARRKGHDETGHREQNYTLPEEITRDISLGSFAYESHSKALSRHAPSQGTELPQSNRDNIRTAKSNGISLPYTPNSFTPLPGSSLYIINPANKGYLVETDPRFANYRQWLGSDYMLGSLKLDPNNLHKRLGDGYYEQRLINEQIAELTGHRRLDGYQNDEEQFKALMDNGATAARSMNLSVGIALSAEQAAQLTSDIVWLVQKEVKLPDGGTQTVLMPQVYVRVKNGGIDGKGALLSGSNTQINVSGSLKNSGTIAGRNALIINTDTLDNIGGRIHAQKSAVTATQDINNIGGILSAEQTLLLNAGNNINNQSTAKSSQNAQGSSTYLDRMAGIYITGKEKGVLAAQAGKDINIIAGQISNQSDQGQTRLQAGRDINLDTVQTGKYQEIHFDADNHTIRGSTNEVGSSIQTKGDVTLLSGNNLNAKAAEVGSAKGTLAVYAKNDITISSGIHAGQVDDASKHTGRSGGGNKLVITDKAQSHHETAQSSTFEGKQVVLQAGNDANILGSNVISDNGTRIQAGNHVRIGTTQTQSQSETYHQTQKSGLMSAGIGFTIGSKTNTQENQSQSNEHTGSTVGSLKGDTTIVASKHYEQTGSNVSSPEGNNLISTQSMDIGAAQNQLNSKTTQTYEQKGLTVAFSSPVTDLAQQAIAVAHKAAKQFDKAKTTALMPWRLPMQVGRLFKQAKAPKK

SEQ ID NO: 289 - protein, 721 aa, Neisseria
LLVQTEKDGLHNEQTFGEKKVFSENGKLHNYWRARRKGHDETGHREQNYTLPEEITRDISLGSFAYESHSKALSRHAPSQGTELPQSNRDNIRTAKSNGISLPYTPNSFTPLPGSSLYIINPANKGYLVETDPRFANYRQWLGSDYMLGSLKLDPNNLHKRLGDGYYEQRLINEQIAELTGHRRLDGYQNDEEQFKALMDNGATAARSMNLSVGIALSAEQAAQLTSDIVWLVQKEVKLPDGGTQTVLMPQVYVRVKNGGIDGKGALLSGSNTQINVSGSLKNSGTIAGRNALIINTDTLDNIGGRIHAQKSAVTATQDINNIGGILSAEQTLLLNAGNNINNQSTAKSSQNAQGSSTYLDRMAGIYITGKEKGVLAAQAGKDINIIAGQISNQSDQGQTRLQAGRDINLDTVQTGKYQEIHFDADNHTIRGSTNEVGSSIQTKGDVTLLSGNNLNAKAAEVGSAKGTLAVYAKNDITISSGIHAGQVDDASKHTGRSGGGNKLVITDKAQSHHETAQSSTFEGKQVVLQAGNDANILGSNVISDNGTRIQAGNHVRIGTTQTQSQSETYHQTQKSGLMSAGIGFTIGSKTNTQENQSQSNEHTGSTVGSLKGDTTIVASKHYEQTGSNVSSPEGNNLISTQSMDIGAAQNQLNSKTTQTYEQKGLTVAFSSPVTDLAQQAIAVAHKAANKSDKAKTTALMPWRLPMQVGRPIKQAKAHKT

SEQ ID NO: 290 - protein, 230 aa, Neisseria
  VARIANT (1)...(230): Xaa = Any Amino Acid
SGNNLNAKAAEVSSANGTLAVSANNDINISAGINTTHVDDASKHTGRSGGGNKLVITDKAQSHHETAQSSTFEGKQVVLQAGNDANILGSNVISDNGTQIQAGNHVRIGTTQTQSQSETYHQTQKSGLMSAGIGFTIGSKTNTQENQSQSNEHTGSTVGSLKGDTTIVAGKHYEQIGSTVSSPEGNNTIYAQSIDIQAAHNKLNSNTTQTYEQKXLTVAFSSPVTDLAQQ

SEQ ID NO: 291 - protein, 721 aa, Neisseria
LLVQTEKDGLHNEQTFGEKKVFSENGKLHNYWRARRKGHDETGHREQNYTLPEEITRDISLGSFAYESHSKALSRHAPSQGTELPQSNRDNIRTAKSNGISLPYTPNSFTPLPGSSLYIINPANKGYLVETDPRFANYRQWLGSDYMLGSLKLDPNNLHKRLGDGYYEQRLINEQIAELTGHRRLDGYQNDEEQFKALMDNGATAARSMNLSVGIALSAEQAAQLTSDIVWLVQKEVKLPDGGTQTVLMPQVYVRVKNGGIDGKGALLSGSNTQINVSGSLKNSGTIAGRNALIINTDTLDNIGGRIHAQKSAVTATQDINNIGGILSAEQTLLLNAGNNINNQSTAKSSQNAQGSSTYLDRMAGIYITGKEKGVLAAQAGKDINIIAGQISNQSDQGQTRLQAGRDINLDTVQTGKYQEIHFDADNHTIRGSTNEVGSSIQTKGDVTLLSGNNLNAKAAEVGSAKGTLAVYAKNDITISSGIHAGQVDDASKHTGRSGGGNKLVITDKAQSHHETAQSSTFEGKQVVLQAGNDANILGSNVISDNGTRIQAGNHVRIGTTQTQSQSETYHQTQKSGLMSAGIGFTIGSKTNTQENQSQSNEHTGSTVGSLKGDTTIVASKHYEQTGSNVSSPEGNNLISTQSMDIGAAQNQLNSKTTQTYEQKGLTVAFSSPVTDLAQQAIAVAHKAAKQFDKAKTTALMPWRLPMQVGRLFKQAKAPKK

SEQ ID NO: 292 - protein, 721 aa, Neisseria; identical to SEQ ID NO: 289

SEQ ID NO: 293 - protein, 175 aa, Neisseria
  VARIANT (1)...(175): Xaa = Any Amino Acid
MIYIVLFLAVVLAVVAYNMYQENQYRKKVRDQFGHSDKDALLNSXTSHVRDGKPSGGSVMMPKPQPAVKKTAKPQDPXMRNLQEQDAVYIAKQKQAKASPFKTEIETALEESGIIGNSAHTVSEPQTGHSATKPADASAKPAPVPQTPAKPLITLKELSKVELSWFDVRIDFISY

SEQ ID NO: 294 - protein, 428 aa, Neisseria
MIYIVLFLAVVLAVVAYNMYQENQYRKKVRDQFGHSDKDALLNSKTSHVRDGKPSGGSVMMPKPQPAVKKTAKPQDPAMRNLQEQDAVYIAKQKQAKASPFKTEIETALEESGIIGNSAHTVSEPQTGHSAPKPADAPAKPAPVPQTPAKPLITLKELSKVELPWFDVRFDFISYIALTEAKELHALPRLSNRCRYQIVGCTMDDHFQIAEPIPGIRYQAFIVGIQAVSRNGLASQEELSAFNRQVDAFAQSMGGQTLHTDLAAFIEVASALDAFCARVDQTIAIHLVSPTSISGVELRSAVTGVGFVLEDDGAFHYTDTSGSTMFSICSLNNEPFTNALLDNQSYKGFSMLLDIPHSPAGEKTFDDLFMDLAVRLSGQLNLNLVNDKMEEVSTQWLKDVRTYVLARQSEMLKVGIEPGGKTALRLFS

SEQ ID NO: 295 - protein, 428 aa, Neisseria
MIYIVLFLAAVLAVVAYNMYQENQYRKKVRDQFGHSDKDALLNSKTSHVRDGKPSGGPVMMPKPQPAVKKTAKSQDPAMRNLQEQDAVYIAKQKQAKASPFKTEIETALEESGIIGNSAHTVPEPQTGHSAPKPADAPAKPVPVPQTPAKPLITLKELSKVELPWFDVRFDFISYIALTEAKELHALPRLSNRCRYQIVGCTMDDHFQIAEPIPGIRYQAFIVGIQAVSRNGLASQEELSAFNRQVDAFAHSMGGQTLHTDLAAFIEVASALDAFCARVDQTIAIHLVSPTSISGVELRSAVTGVGFVLEDDGAFHYTDTSGSTMFSICSLNNEPFTNALLDNQSYKGFSMLLDIPHSPAGEKTFDDLFMDLAVRLSGQLNLNLVNDKMEEVSTQWLKDVRTYVLARQSEMLKVGIEPGGKTALRLFS

SEQ ID NO: 296 - protein, 428 aa, Neisseria
MIYIVLFLAAVLAVVAYNMYQENQYRKKVRDQFGHSDKDALLNSKTSHVRDGKPSGGPVMMPKPQPAVKKPAKPQDSAMRNLQEQDAVYIAKQKQAKASPFKTEIETALEEIGIIGNSAHTVSEPQTGHSAPKPADAPAKPVPVPQTPAKPLITLKELSKVELPWFDVRFDFISYIALTEAKELHALPRLSNRCRYQIVGCTMDDHFQIAEPIPGIRYQAFIVGIQAVSRNGLASQEELSAFNRQADAFAQSMGGQTLHTDLAAFIEVASALDAFCARVDQTIAIHLVSPTSISGVELRSAVTGVGFVLEDDGAFHYTDTSGSTMFSICSLNNEPFTNALLDNQSYKGFSMLLDIPHSPAGEKTFDDLFMDLAVRLSGQLNLNLVNDKMEEVSTQWLKDVRTYVLARQSEMLKVGIEPGGKTALRLFS

SEQ ID NO: 297 - protein, 154 aa, Neisseria
  VARIANT (1)...(154): Xaa = Any Amino Acid
ARHGTEDFFMNNSDXIRQIVESTTGTMKLLISSIALISLVVGGIGVMNIMLVSVTERTKEIGIRMAIGARRGNIXQQFLIEAVLICVIGGLVGVGLSAAVSLVFNHFVTDFPMDISAMSVIGAVACSTGIGIAFGFMPANKAAKLNPIDALAQD

SEQ ID NO: 298 - protein, 388 aa, Neisseria
MSVQAVLAHKMRSLLTMLGIIIGIASVVSVVALGNGSQKKILEDISSIGTNTISIFPGRGFGDRRSGRIKTLTIDDAKIIAKQSYVASATPMTSSGGTLTYRNTDLTASLYGVGEQYFDVRGLKLETGRLFDENDVKEDAQVVVIDQNVKDKLFADSDPLGKTILFRKRPLTVIGVMKKDENAFGNSDVLMLWSPYTTVMHQITGESHTNSITVKIKDNANTQVAEKGLTDLLKARHGTEDFFMNNSDSIRQIVESTTGTMKLLISSIALISLVVGGIGVMNIMLVSVTERTKEIGIRMAIGARRGNILQQFLIEAVLICVIGGLVGVGLSAAVSLVFNHFVTDFPMDISAMSVIGAVACSTGIGIAFGFMPANKAAKLNPIDALAQD

SEQ ID NO: 299 - protein, 388 aa, Neisseria; identical to SEQ ID NO: 298

SEQ ID NO: 300 - protein, 388 aa, Neisseria
MSVQAVLAHKMRSLLTMLGIIIGIASVVSVVALGNGSQKKILEDISSMGTNTISIFPGRGFGDRRSGKIKTLTIDDAKIIAKQSYVASATPMTSSGGTLTYRNTDLTASLYGVGEQYFDVRGLKLETGRLFDENDVKEDAQVVVIDQNVKDKLFADSDPLGKTILFRKRPLTVIGVMKKDENAFGNSDVLMLWSPYTTVMHQITGESHTNSITVKIKDNANTRVAEKGLAELLKARHGTEDFFMNNSDSIRQMVESTTGTMKLLISSIALISLVVGGIGVMNIMLVSVTERTKEIGIRMAIGARRGNILQQFLIEAVLICIIGGLVGVGLSAAVSLVFNHFVTDFPMDISAASVIGAVACSTGIGIAFGFMPANKAAKLNPIDALAQD

SEQ ID NO: 301 - protein, 201 aa, Neisseria
GTGAMLLLFYAVTILPLATGVTLSYTSSIFLAVFSFLILKERISVYTQAVLLLGFAGVVLLLNPSFRSGQETAALAGLAGGAMSGWAYLKVRELSLAGEPGWRVVFYLSVTGVAMSSVWATLTGWHTLSFPSAVYLSCIGVSALIAQLSMTRAYKVGDKFTVASLSYMTVVFSALSAAFFLGEELFWQEILGMCIIISAVF

SEQ ID NO: 302 - protein, 300 aa, Neisseria
  VARIANT (1)...(300): Xaa = Any Amino Acid
MDTAKKDILGSGWMLVAAACFTIMNVLIKEASAKFALGSGELVFWRMLFSTVALGAAAVLRRDXFRTPHWKNHLNRSMVGTGAMLLLFYAVTHLPLATGVTLSYTSSIFLAVFSFLILKERISVYTQAVLLLGFAGVVLLLNPSFRSGQETAALAGLAGGAMSGWAYLKVRELSLAGEPGWRVVFYLSVTGVAMSSVWATLTGWHTLSFPSAVYLSCIGVSALIAQLSMTRAYKVGDKFTVASLSYMTVVFSALSAAFFLGEELFWQEILGMCIIILSGILSSIRPTAFKQRLQSLFRQR

SEQ ID NO: 303 - protein, 300 aa, Neisseria
MDTAKKDILGSGWMLVAAACFTIMNVLIKEASAKFALGSGELVFWRMLFSTVALGAAAVLRRDTFRTPHWKNHLNRSMVGTGAMLLLFYAVTHLPLATGVTLSYTSSIFLAVFSFLILKERISVYTQAVLLLGFAGVVLLLNPSFRSGQETAALAGLAGGAMSGWAYLKVRELSLAGEPGWRVVFYLSVTGVAMSSVWATLTGWHTLSFPSAVYLSCIGVSALIAQLSMTRAYKVGDKFTVASLSYMTVVFSALSAAFFLAEELFWQEILGMCIIILSGILSSIRPTAFKQRLQSLFRQR

SEQ ID NO: 304 - protein, 506 aa, Neisseria
MPSEKAFRRHLRTASFQGLHLHHFHQKVGKCGIIGFGIHIFPTLLPAAQGILDIQLGLFRIDFAALAVYRRTQVDFIHTVIDGIASDQAFSEVVQILRRLNLGHFTDTHLIAQARRFIADFGNIRPMRRGEAKTFCRCFRFDGIDGIHGDFRQCGHINRLAPGKDCRNGKRDKVFFHTRHYNQVCLEKTNCSARKIKFRHQKQAKTHSTSLAARFTIRPSLSQRPFMDTAKKDILGSGWMLVAAACFTVMNVLIKEASAKFALGSGELVFWRMLFSTVTLGAAAVLRRDTFRTPHWKNHLNRSMVGTGAMLLLFYAVTHLPLTTGVTLSYTSSIFLAVFSFLILKERISVYTQAVLLLGFAGVVLLLNPSFRSGQEPAALAGLAGGAMSGWAYLKVRELSLAGEPGWRVVFYLSATGVAMSSVWATLTGWHTLSFPSAVYLSGIGVSALIAQLSMTRAYKVGDKFTVASLSYMTVVFSALSAAFFLGEELFWQEILGMCIIISAAF

SEQ ID NO: 305 - protein, 300 aa, Neisseria
MDTAKKDILGSGWMLVAAACFTVMNVLIKEASAKFALGSGELVFWRMLFSTVTLGAAAVLRRDTFRTPHWKNHLNRSMVGTGAMLLLFYAVTHLPLTTGVTLSYTSSIFLAVFSFLILKERISVYTQAVLLLGFAGVVLLLNPSFRSGQEPAALAGLAGGAMSGWAYLKVRELSLAGEPGWRVVFYLSATGVAMSSVWATLTGWHTLSFPSAVYLSGIGVSALIAQLSMTRAYKVGDKFTVASLSYMTVVFSALSAAFFLGEELFWQEILGMCIIILSGILSSIRPIAFKQRLQALFRQR

SEQ ID NO: 306 - protein, 234 aa, Neisseria
  VARIANT (1)...(234): Xaa = Any Amino Acid
MKRRIAVFVLFPQIIRVLGQLLPKIVNTVPAHRMLFQIFGMFFFFIHQQYLPGIAEIDSPCGIVFGALLFRHLPAHCLYGKAAVGDAVAHEHPVADVVNRNANAFALFDIGQFAXFIVQHTVNIKTVKINIVDPHMFANFAVFAVLEKRDFDHGKIQGGNNAAAFPKKLAPKIFECFTGAFVGTVYRFVCLFYIINDGIAHHSAPQRVRYLFAPYCGFLPSASDSDLKSSXXSE

SEQ ID NO: 307 - protein, 235 aa, Neisseria
MMKRRIAVFVLFPQIIRVLGQLLPKIVNTVPAHRMLFQIFGMFFFFIHQQYLPGIAEIDSPCGIVFGALLFRHLPAHCLYGKAAVGDAVAHEHPVADVVNRNANAFALFDIGQFAGFIVQHTVNIKTVKINIVDPHMFANFAVFAVLEKRDFDHGKIQGGNNAAAFPKKLAPKIFECFTGAFVGTVYRFVCLFYIINDGIAHHSAPQRVRYLFAPYCGFLPSASDSDLKSSKYSE

SEQ ID NO: 308 - protein, 234 aa, Neisseria
  VARIANT (1)...(234): Xaa = Any Amino Acid
MMKRRIAVFVLLMQKIRILGQLLPKIVNTVPAHRMLFQXFGMFFFFIHQQYLPGIAEIDSPCGIVFGTLLFRHXSTHCLYGKAAVGNAVAHEHPVADVVNRNANAFALFDIGQFAGFIVQHAINVKTVKINIVDPHMFANFAXFAVLEKRALTMAKSKXXXMRRRSQKSSRQKYLNVLRARSPARFTGLSACSTXMTESPIISAPQRVRYLFAPYCGFLPSASDSDLKSSKYSE

SEQ ID NO: 309 - protein, 235 aa, Neisseria
MMKRRIAVFVLLMQKIRILGQLLPKIVNTVPAHRMLFQIFGMFFFFIHRQYLPGIAEIDSPGGIVFGTLLFRHLSAHCLYGKAAVGDAVAHEHPVADVANRNANAFALFDIGQSAGFIVQHTVNIKTVKINIVDPHMFANFAVFAVLEKRDFDHGKIQGGNNAAAFPKKLAPKVFECFTGAFAGTVYRFVCLFYIINDGIAHHTAPQRVRYLFAPYRGFLPPASDSDLKSSKYSE

SEQ ID NO: 310 - protein, 149 aa, Neisseria
  VARIANT (1)...(149): Xaa = Any Amino Acid
MENMVTFSKIRPLLAIAAAALLAAXRTAGNNAVRKPVQTAKPAAVVGLALGGGASKGFAHVGIIKVLKENGIPVKVVTGTSAGSIVGNLFASGMSPDRLELEAEILGKTDLVDLTLSTNGFIKGAKLQNYINRKLRGMQIQQFPIKFAA

SEQ ID NO: 311 - protein, 300 aa, Neisseria
MENMVTFSKIRPLLAIAAAALLAACGTAGNNAVRKPVQTAKPAAVVGLALGGGASKGFAHVGIIKVLKENGIPVKVVTGTSAGSIVGSLFASGMSPDRLELEAEILGKTDLVDLTLSTSGFIKGEKLQNYINRKVGGRQIQQFPIKFAAVATDFETGKAVAFNQGNAGQAVRASAAIPNVFQPVIIGRHTYVDGGLSQPVPVSAARRQGANFVIAVDISARPGKNISQGFFSYLDQTLNVMSVSALQNELGQADVVIKPQVLDLGAVGGFDQKKRAIRLGEEAARAALPEIKRKLAAYRY

SEQ ID NO: 312 - protein, 300 aa, Neisseria
  VARIANT (1)...(300): Xaa = Any Amino Acid
MENMVTFSKIRPLLAIAAAALLAACGTAGNNAARKPVQTAKPAAVVGLALGGGASKGFAHVGIIKVLKENGIPVKVVTGTSAGSIVGSLFASGMSPDRLELEAEILGKTDLVDLTLSTSGFIKGEKLQNYINRKVGGRRIQQFPIKFAAVATDFETGKAVAFNQGNAGQAVRASAAIPNVFQPVIIGRHTYVDGGLSQPVPVSAARRXXXXXVIAVDISARPSKNISQGFFSYLDQTLNVMSVSALQNELGQADVVIKPQVLDLGAVGGFDQKKRAIRLGEEAARAALPEIKRKLAAYRY

SEQ ID NO: 313 - protein, 300 aa, Neisseria
MENMVTFSKIRSFLAIAAAALLAACGTAGNNAARKPVQTAKPAAVVALALGGGASKGFAHIGIVKVLKENGIPVKVVTGTSAGSIVGSLLASGMSPDRLELEAEILGKTDLVDLTLSTSGFIKGEKLQNYINRKVGGRQIQQFPIKFAAVATDFETGKAVAFNQGNAGQAVRASAAIPNVFQPVIIGRHKYVDGGLSQPVPVSAARRQGANFVIAVDISARPSKNVGQGFFSYLDQTLNVMSVSVLQNELGQADVVIKPQVLDLGAVGGFDQKKRAIRLGEEAARAALPEIKRKLAAYRY

SEQ ID NO: 314 - protein, 123 aa, Neisseria
  VARIANT (1)...(123): Xaa = Any Amino Acid
MFRLQFRLFPPLRTAMHILLTALLKCLSLLPLSCLHTLGNRLGHLAFYLLKEDRARIVAXMRQAGLNPDPKTVKAVFAETAKGGLELAPAFFRKPEDIETMFKAVHGWEHVQQALDKHEGLLF

SEQ ID NO: 315 - protein, 298 aa, Neisseria
MFRLQFRLFPPLRTAMHILLTALLKCLSLLPLSCLHTLGNRLGHLAFYLLKEDRARIVANMRQAGLNPDPKTVKAVFAETAKGGLELAPAFFRKPEDIETMFKAVHGWEHVQQALDKHEGLLFITPHIGSYDLGGRYISQQLPFPLTAMYKPPKIKAIDKIMQAGRVRGKGKTAPTSIQGVKQIIKALRSGEATIVLPDHVPSPQEGGEGVWVDFFGKPAYTMTLAAKLAHVKGVKTLFFCCERLPGGQGFDLHIRPVQGELNGDKAHDAAVFNRNAEYWIRRFPTQYLFMYNRYKMP

SEQ ID NO: 316 - protein, 298 aa, Neisseria; identical to SEQ ID NO: 315

SEQ ID NO: 317 - protein, 297 aa, Neisseria
MFRLQFRLFPPLRTAMHILLTALLKCLSLLSLSCLHTLGNRLGHLAFYLLKEDRARIVANMRQAGLNPDTQTVKAVFAETAKCGLELAPAFFKKPEDIETMFKAVHGWEHVQQALDKGEGLLFITPHIGSYDLGGRYISQQLPFHLTAMYKPPKIKAIDKIMQAGRVRGKGKTAPTGIQGVKQIIKALRAGEATIILPDHVPSPQEGGGVWADFFGKPAYTMTLAAKLAHVKGVKTLFFCCERLPDGQGFVLHIRPVQGELNGNKAHDAAVFNRNTEYWIRRFPTQYLFMYNRYKTP

SEQ ID NO: 318 - protein, 189 aa, Neisseria
  VARIANT (1)...(189): Xaa = Any Amino Acid
AWSAGESWRVLMESETWHAVWNTLRFSAAAVYAAAVLGVVYAAPARRSAWMRGLMFXPFMVSPVCVSAGVLLLYPQWTASLPLLLAMYALLAYPFVAKDVLSAWDALPPDYGRAAAGLGANGFQTACRITFPLLKPALRRGLTLAAATCVGEFAATLFLSRPEWQTLTTLIYAYLGRAGEDNYARAMVL

SEQ ID NO: 319 - protein, 513 aa, Neisseria
MDGRRWVVWGAFALLPSAFLAVMVVAPLWAVAAYDGLAWRAVLSDAYMLKRLAWTVFQAAATCVLVLPLGVPVAWVLARLAFPGRALVLRLLMLPFVMPTLVAGVGVLALFGADGLLWRGRQDTPYLLLYGNVFFNLPVLVRAAYQGFVQVPAARLQTARTLGAGAWRRFWDIEMPVLRPWLAGGVCLVFLYCFSGFGLALLLGGSRYATVEVEIYQLVMFELDMAVASVLVWLVLGVTAAAGLLYAWFGRRAVSDKAVSPVMPSPPQSVGEYVLLAFAAAVLSVCCLFPLLAIVVKAWSAGESWRVLMESETWQAVWNTLRFSAAAVYAAAVLGVVYAAAARRSAWMRGLMFLPFMVSPVCVSAGVLLLYPQWTASLPLLLAMYALLAYPFVAKDVLSAWDALPPDYGRAAAGLGANGFQTACRITFPLLKPALRRGLTLAAATCVGEFAATLFLSRPEWQTLTTLIYAYLGRAGEDNYARAMVLTLLLAAFALGIFLLLDGGEGGKQTETL

SEQ ID NO: 320 - protein, 513 aa, Neisseria
  VARIANT (1)...(513): Xaa = Any Amino Acid
MDGRRWAVWGAFALLPSAFLAAMVVAPLWAVAAYDGLAWRAVLSDAYMLKRLAWTVFQAAATCVLVLPLGVPVAWVLARLAFPGRALVLRLLMLPFVMPTLVAGVGVLALFGADGLXWRGWQDTPYLLLYGNVFFXLPVLVRAAYQGFVQVPAARLQTAXTLGAGAWRRFWDIEMPVLRPWLAGGVCLVFLYCFSGFGLALLLGGSRYATVEVEIYQLVMFELDMAVASVLVWLVXGVTAAAGLLYAWFGRRAVSDKAVSPVMPSPPQSVGEYVLLAFAAAVXSVCCLFXLLAIVVKAWSAGESWRVLMESETWQAVWNTXRFSAAAVYAAAVLGVVYAAAARRSAWMRGLMFLPFMVSPVCVSAGVLLLXPQWTASLPLLLAMYALLAYPFVAKDVLSAXDALPPDYGRAAAGLGANGFQTACRITFPLLKPALRRGLTLAAATCVGEFAATLFXSRXEWQTLTTLIYAYXGRAGXDNYARAMVLTLLLAAFALGXFLLLDGGEGGKRTETL

SEQ ID NO: 321 - protein, 513 aa, Neisseria
MDGRCWAVRGAFSLLPSAFLAVMVVAPLWAVAAYDGLAWRAVLSDAYMLKRLAWTVFQAAATCVLVLPLGVPVAWVLARLAFPGRALVLRLLMLPFVMPTLVAGVGVLALFGADGLLWRGRQDTPYLLLYGNVFFNLPVLVRAAYQGFAQVPAARLQTARTLGAGAWRPFWDIEMPVLRPWLAGGVCLVFLYCFSGFGLALLLGGSRYATVEVEIYQLVMFELDMAGASALVWLVLGVTAAAGLLYAWFGRRAVSDKAVSPVMPSPPQSVGEYVLLAFSVAVLSVCCLFPLSAIVVKAWSAGESRRVLMESETWQAVWNTLRFSAAAVFAAAVLGVVYAAAARRLVWMRGLVFLPFMVSPVCVSAGVLLLYPGWTASLPLLLAMYALLAYPFVAKDVLSAWDALPPDYGRAAAGLGANGFQTACRITFPLLKPALRRGLTLAAATCVGEFAATLFLSRPEWQTLTTLIYAYLGRAGEDNYARAMVLTLLLSAFAVCIFLLLDNGEGGKRTETL

SEQ ID NO: 322 - protein, 513 aa, Neisseria
MDGRCWAVRGAFSLLPSAFLAVMVVAPLWAVAAYDGLAWRAVLSDAYMLKRLAWTVFQAAATCVLVLPLGVPVAWVLARLAFPGRALVLRLLMLPFVMPTLVAGVGVLALFGADGLLWRGRQDTPYLLLYGNVFFNLPVLVRAAYQGFAQVPAARLQTARTLGAGAWRRFWDIEMPVLRPWLAGGVCLVFLYCFSGFGLALLLGGSRYATVEVEIYQLVMFELDMAGASALVWLVLGVTAAAGLLYAWFGRRAVSDKAVSPVMPSPPQSVGEYVLLAFSVAVLSVCCLFPLSAIVVKAWSAGESRRVLMESETWQAVWNTLRFSAAAVFAAAVLGVVYAAAARRLVWMRGLVFLPFMVSPVCVSAGVLLLYPGWTASLPLLLAMYALLAYPFVAKDVLSAWDALPPDYGRAAAGLGANGFQTACRITFPLLKPALRRGLTLAAATCVGEFAATLFLSRPEWQTLTTLIYAYLGRAGEDNYARAMVLTLLLSAFAVCIFLLLDNGEGGKRTETL

SEQ ID NO: 323 - protein, 87 aa, Neisseria
MDGWTQTLSAQTLLGISAAAIILILILIVRFRIHALLTLVIVSLLTALATGLPTGSIVKDILVKNFGGTLGGVALLVGLGAMLERLV

SEQ ID NO: 324 - protein, 461 aa, Neisseria
MDGWTQTLSAQTLLGISAAAIILILILIVKFRIHALLTLVIVSLLTALATGLPTGSIVNDILVKNFGGTLGGVALLVGLGAMLGRLVETSGGAQSLADALIRMFGEKRAPFALGVASLIFGFPIFFDAGLIVMLPIVFATARRMKQDVLPFALASIGAFSVMHVFLPPHPGPIAASEFYGANIGQVLILGLPTAFITWYFSGYMLGKVLGRTIHVPVPELLSGGTQDNDLPKEPAKAGTVVAIMLIPMLLIFLNTGVSALISEKLVSADETWVQTAKIIGSTPIALLISVLVALFVLGRKRGESGSALEKTVDGALAPVCSVILITGAGGMFGGVLRASGIGKALADSMADLGIPVLLGCFLVALALRIAQGSATVALTTAAALMAPAVAAAGFTDWQLACIVLATAAGSVGCSHFNDSGFWLVGRLLDMDVPTTLKTWTVNQTLIALIGFALSALLFAIV

SEQ ID NO: 325 - protein, 461 aa, Neisseria
MDGWTQTLSAQTLLGISAAAIILILILIVKFRIHALLTLVIVSLLTALATGLPTGSIVNDVLVKNFGGTLGGVALLVGLGAMLGRLVETSGGAQSLADALIRMFGEKRAPFALGVASLIFGFPIFFDAGLIVMLPIVFATARRMKQDVLPFALASIGAFSVMHVFLPPHPGPIAASEFYGANIGQVLILGLPTAFITWYFSGYMLGKVLGRTIHVPVPELLSGGTQDNDLPKEPAKAGTVVAIMLIPMLLIFLNTGVSALISEKLVSADETWVQTAKIIGSTPIALLISVLVALFVLGRKRGESGSALEKTVDGALAPVCSVILITGAGGMFGGVLRASGIGKALADSMADLGIPVLLGCFLVALALRIAQGSATVALTTAAALMAPAVAAAGFTDWQLACIVLATAAGSVGCSHFNDSGFWLVGRLLDMDVPTTLKTWTVNQTLIALIGFALSALLFAIV

SEQ ID NO: 326 - protein, 461 aa, Neisseria
MDGRTQTLSAQTLLGISAAAIILILILIVKFRIRALLTLVIASLLTALATGLPTGSIVNDVLVKNFGGTLGGVALLVGLGAMLGRLVETSGGAQSLADALIRMFGEKRAPFAPGVASLIFGFPIFFDAGLIVMLPIVFATARRMKQDVLPFALASVGAFSVMHVFLPPHPGPIAASEFYGANIGQVLILGLPTAFITWYFSGYMLGKVLGRAIHVPVPELLSGGTQDSDPPKEPAKAGTVVAVMLIPMLLIFLNTGVSALISEKLVSADETWVQTAKMIGSTPVALLISVLAALLVLGRKRGESGSTLEKTVDGALAPACSVILITGAGGMFGGVLRASGIGKALADSMADLGIPVLLGCFLVALALRIAQGSATVALTTAAALMAPAVAAAGFTDWQLACIVLATAAGSVGCSHFNDSGFWLVGRLSDMDVPTTLKTWTVNQTLIAFIGFALSALLFAIV

SEQ ID NO: 327 - protein, 461 aa, Neisseria
MDGRTQTLSAQTLLGISAAAIILILILIVKFRIRALLTLVIASLLTALATGLPTGSIVNDVLVKNFGGTLGGVALLVGLGAMLGRLVETSGGAQSLADALIRMFGEKRAPFAPGVASLIFGFPIFFDAGLIVMLPIVFATARRMKQDVLPFALASVGAFSVMHVFLPPHPGPIAASEFYGANIGQVLILGLPTAFITWYFSGYMLGKVLGRAIHVPVPELLSGGTQDSDPPKEPAKAGTVVAVMLIPMLLIFLNTGVSALISEKLVSADETWVQTAKMIGSTPVALLISVLAALLVLGRKRGESGSTLEKTVDGALAPACSVILITGAGGMFGGVLRASGIGKALADSMADLGIPVLLGCFLVALALRIAQGSATVALTTAAALMAPAVAAAGFTDWQLACIVLATAAGSVGCSHFNDSGFWLVGRLLDMDVPTTLKTWTVNQTLIAFIGFALSALLFAIV

SEQ ID NO: 328 - protein, 140 aa, Neisseria
  VARIANT (1)...(140): Xaa = Any Amino Acid
DFGISPVYLWVAAAFKHLLSPWAADSYDVARFAGVFFAVIGLTSCGFAGFNFLGRHHGRXVVLILIGCIGLIPVAHFLNPAAAAFAAAGLVLHGYSLARRRVIAASFLLGTGWTLMSLAAAYPAAFALMLPLPVLMFFRP

SEQ ID NO: 329 - protein, 553 aa, Neisseria
MLTYTPPDARPPAKTHEKPWLLLLMAFAWLWPGVFSHDLWNPDEPAVYTAVEALAGSPTPLVAHLFGQTDFGIPPVYLWVAAAFKHLLSPWAADSYDAARFAGVFFAVIGLTSCGFAGFNFLGRHHGRSVVLILIGCIGLIPVAHFLNPAAAAFAAAGLVLHGYSLARRRVIAASFLLGTGWTLMSLAAAYPAAFALMLPLPVLMFFRPWQSRRLMLTAVASLAFALPLMTVYPLLLAKTQPALFAQWLDYHVFGTFGGVRHVQTAFSLFYYLKNLLWFALPALPLAVWTVCRTRLFSTDWGILGVVWMLAVLVLLAVNPQRFQDNLVWLLPPLALFGAAQLDSLRRGAAAFVNWFGIMAFGLFAVFLWTGFFAMNYGWPAKLAERAAYFSPYYVPDIDPIPMAVAVLFTPLWLWAITRKNIRGRQAVTNWAAGVTLTWALLMTLFLPWLDAAKSHAPVVRSMEASLSPELKRELSDGIECIGIGGGDLHTRIVWTQYGTLPHRVGDVQCRYRIVLLPQNADAPQGWQTVWQGARPRNKDSKFALIRKIGENI

SEQ ID NO: 330 - protein, 558 aa, Neisseria
MLTYTPPDARPPAKTHEKPWLLLLMAFAWLWPGVFSHDLWNPDEPAVYTAVEALAGSPTPLVAHLFGQIDFGIPPVYLWVAAAFKHLLSPWAADPYDAARFAGVFFAVVGLTSCGFAGFNFLGRHHGRSVVLILIGCIGLIPTVHFLNPAAAAFAAAGLVLHGYSLARRRVIAASFLLGTGWTLMSLAAAYPAAFALMLPLPVLMFFRPWQSRRLMLTAVASLAFALPLMTVYPLLLAKTQPALFAQWLDDHVFGTFGGVRHIQTAFSLFYYLKNLLWFALPALPLAVWTVCRTRLFSTDWGILGVVWMLAVLVLLAVNPQRFQDNLVWLLPPLALFGAAQLDSLRRGAAAFVNWFGIMAFGLFAVFLWTGFFAMNYGWPAKLAERAAYFSPYYVPDIDPIPMAVAVLFTPLWLWAITRKNIRGRQAVTNWAAGVTLTWALLMTLFLPWLDAAKSHAPVVRSMEASLSPELKRELSDGIECIDIGGGDLHTRIVWTQYGTLPHRVGDVQCRYRIVRLPQNADAPQGWQTVWQGARPRNKDSKFALIRKTGENILKTTD

SEQ ID NO: 331 - protein, 585 aa, Neisseria
MPSEAVSARPLCEYLLHLAIRPFLLTLMLTYTPPDARPPAKTHEKPWLLLLMAFAWLWPGVFSHDLWNPAEPAVYTAVEALAGSPTPLVAHLFGQTDFGIPPVYLWVAAAFKHLLSPWAAHPYDAARFAGVFFAVIGLTSCGFAGFNFLGRHHGRSVVLIHIGCIGLIPVAHFFNPAAAAFAAAGLVLHGYSLARRRVIAASFLLGTGWTLMSLAAAYPAAFALMLPLPVLMFFRPWQSRRLMLTAVASLAFALPLMTVYPLLLAKTQPALFAQWLNYHVFGTFGGVRHIQRAFSLFHYLKNLLWFAPPGLPLAVWTVCRTRLFSTDWGILGIVWMLAVLVLLAFNPQRFQDNLVWLLPPLALFGAAQLDSLRRGAAAFVNWFGIMAFGLFAVFLWTGFFAMNYGWPAKLAERAAYFSPYYVPDIDPIPMAVAVLFTPLWLWAITRKNIRGRQAVTNWAAGVTLTWALLMTLFLPWLDAAKSHAPVVRSMEASFSPELKRELSDGIECIGIGGGDLHTRIVWTQYGTLPHRVGDVRCRYRIVRLPQNADAPQGWQTVWQGARPRNKDSKFALIRKIGENILKTTD

SEQ ID NO: 332 - protein, 558 aa, Neisseria
MLTYTPPDARPPAKTHEKPWLLLLMAFAWLWPGVFSHDLWNPAEPAVYTAVEALAGSPTPLVAHLFGQTDFGIPPVYLWVAAAFKHLLSPWAADPYDAARFAGVFFAVIGLTSCGFAGFNFLGRHHGRSVVLIHIGCIGLIPVAHFLNPAAAAFAAAGLVLHGYSLARRRVIAASFLLGTGWTLMSLAAAYPAAFALMLPLPVLMFFRPWQSRRLMLTAVASLAFALPLMTVYPLLLAKTQPALFAQWLNYHVFGTFGGVRHIQRAFSLFHYLKNLLWFAPPGLPLAVWTVCRTRLFSTDWGILGIVWMLAVLVLLAFNPQRFQDNLVWLLPPLALFGAAQLDSLRRGAAAFVNWFGIMAFGLFAVFLWTGFFAMNYGWPAKLAERAAYFSPYYVPDIDPIPMAVAVLFTPLWLWAITRKNIRGRQAVTNWAAGVTLTWALLMTLFLPWLDAAKSHAPVVRSMEASFSPELKRELSDGIECIGIGGGDLHTRIVWTQYGTLPHRVGDVRCRYRIVRLPQNADAPQGWQTVWQGARPRNKDSKFALIRKIGENILKTTD

SEQ ID NO: 333 - protein, 59 aa, Neisseria
QSAKWLSGQTLVGTAIGIRGQIKLGGNLHYDIFTGRALKKPEFFQSRKWASGFQVGYTF

SEQ ID NO: 334 - protein, 342 aa, Neisseria
MDNSGSEATGKYQGNITFSADNPLGLSDMFYVNYGRSIGGTPDEESFDGHRKEGGSNNYAVHYSAPFGKWTWAFNHNGYRYHQAVSGLSEVYDYNGKSYNTDFGFNRLLYRDAKRKTYLGVKLWMRETKSYIDDAELTVQRRKTAGWLAELSHKEYIGRSTADFKLKYKRGTGMKDALRAPEEAFGEGTSRMKIWTASADVNTPFQIGKQLFAYDTSVHAQWNKTPLTSQDKLAIGGHHTVRGFDGEMSLSAERGWYWRNDLSWQFKPGHQLYLGADVGHVSGQSAKWLSGQTLVGTAIGIRGQIKLGGNLHYDIFTGRALKKPEFFQSRKWASGFQVGYTF

SEQ ID NO: 335 - protein, 342 aa, Neisseria
MDNSGSEATGKYQGNITFSADNPFGLSDMFYVNYGRSIGGTPDEENFDGHRKEGGSNNYAVHYSAPFGKWTWAFNHNGYRYHQAVSGLSEVYDYNGKSYNTDFGFNRLLYRDAKRKTYLSVKLWTRETKSYIDDAELTVQRRKTTGWLAELSHKGYIGRSTADFKLKYKHGTGMKDALRAPEEAFGEGTSRMKIWTASADVNTPFQIGKQLFAYDTSVHAQWNKTPLTSQDKLAIGGHHTVRGFDGEMSLPAERGWYWRNDLSWQFKPGHQLYLGADVGHVSGQSAKWLSGQTLAGTAIGIRGQIKLGGNLHYDIFTGRALKKPEYFQTKKWVTGFQVGYSF

SEQ ID NO: 336 - protein, 110 aa, Neisseria
  VARIANT (1)...(110): Xaa = Any Amino Acid
MRTKWSAVRSCTWADTADIDTALNLLYRLQKLEFLYGDENGHSDGINLXDEQLPLLMEQLSGSGKALLVDRNGLYLANANFHHEAAEELGLLAAEVAQMEKKYRLLIKNN

SEQ ID NO: 337 - protein, 214 aa, Neisseria
MESTLSLQANLYPRLTPAGAFYAVSSDAPSAGKTLLHSLLKADADEMVSSEKLLTWADTADIDTALNLLYRLQKLEFLYGDENGHSDGINLSDEQLPLLMEQLSGSGKALLVDRNGLYLANANFHHEAAEELGLLAAEVAQMEKKYRLLIKNNLYINNNAWGVCDPSGQSELTFFPLYIGSTKFILVIGGIPDLGKEAFVTLVRILYRRYSNRV

SEQ ID NO: 338 - protein, 227 aa, Neisseria
  VARIANT (1)...(227): Xaa = Any Amino Acid
MESTXSLQANLYXRLTPAGAFYAVSSDXPSAGKTLLHSLLKADADEMVSSEKLLTWAXTADIDTALNLLYRLQKLEFLYGDENGHSDGINLSDEQLPLLMEQLSGSGKALLVDRNGLYLANANFHHEAAEELGLLAAEVAQMEKKYRLXIKNNLYINNNAWGVCDPSGQSELTFFPLYIGSTKFILVIGGIPDLGKEAFVTLVRXLYXXLQQPRVKLGREXGLCSNY

SEQ ID NO: 339 - protein, 298 aa, Neisseria
MRTKWSAVRSCSRADTADIDTALNLLYRLQKLEFLYGDENGHSDGINLSDEQLPLLMEQLSGSGKALLVDRNGLYLANANFHHESAEELGLLAAEVAQMEKKYRLLIRNNLYINNNAWGVCDPSGQSELTFFPLYIGSTKFILVIAGIPDLSKGGICYFGKDFIPPLQQPRVKLGTGGIMRQLLISILEDLNNTSTDIIASAVISTDGLPMATMLPSHLNSDRVGAISATLLALGSRSVQELACGELEQVMIKGKSGYILLSQAGKDAVLVLVAKETGRLGLILLDAKRAARHIAEAI

SEQ ID NO: 340 - protein, 213 aa, Neisseria
MESTLSLQANLYPCLTPAGAFYAVSSDAPSAGKTLLRSLLKADADEVVSSEKLLAADTADIDTALNLLYRLQKLEFLYGDENGHSDGINLSDEQLPLLMEQLSGSGKALLVDRNGLYLANANFHHESAEELGLLAAEVAQMEKKYRLLIRNNLYINNNAWGVCDPSGQSELTFFPLYIGSTKFILVIAGIPDLSKEAFVTLVRILYRRYSNRV

SEQ ID NO: 341 - protein, 136 aa, Neisseria
  VARIANT (1)...(136): Xaa = Any Amino Acid
MTFLQRLQGLADNKICAFAWFVVRRFDEERVPQXAASMTFTTLLALVPVLTVMVAVASIFPVFDRWSDSFVSFVNQTIVPXGADMVFDYINAFREQANRLTAIGSVMLVVTSLMLIRTIDNTFNRIWRVXXQRPWM

SEQ ID NO: 342 - protein, 406 aa, Neisseria
MTFLQRLQGLADNKICAFAWFVVRRFDEERVPQAAASMTFTTLLALVPVLTVMVAVASIFPVFDRWSDSFVSFVNQTIVPQGADMVFDYINAFREQANRLTAIGSVMLVVTSLMLIRTIDNTFNRIWRVNSQRPWMMQFLVYWALLTFGPLSLGVGISFMVGSVQDAALASGAPQWSGALRTAATLTFMTLLLWGLYRFVPNRFVPARQAFVGALATAFCLETARSLFTWYMGNFDGYRSIYGAFAAVPFFLLWLNLLWTLVLGGAVLTSSLSYWQGEAFRRGFDSRGRFDDVLKILLLLDAAQKEGKALPVQEFRRHINMGYDELGELLEKLARHGYIYSGRQGWVLKTGADSIELNELFKLFVYRPLPVERDHVNQAVDAVMTPCLQTLNMTLAEFDAQAKKRQ

SEQ ID NO: 343 - protein, 408 aa, Neisseria
  VARIANT (1)...(408): Xaa = Any Amino Acid
MTFLQRLQGLADNKICAFAWFVVRRFDEERVPQAAASMTFTTLLALVPVLTVMVAVASIFPVFDRWSDSFVSFVNQTIVPQGADMVFDYINAFREQANRLTAIGSVMLVVTSXMLIRTIDNTFNRIWRVNSQRPWMMQFLVYWALLTFGPLSLGVGISFXVGSVQDAALASGAPQWSGALRTAATLXFMTLLLWGLYRXVPNRFVPARXAFVGALATAFCLETARSLFTWYMGNFDGYRSIYGAFAAVPFFLLWLNLLWTLVLGGAVLTSSLSYWQGEAFRRXFDSRGRFDDVLKILLLLDAAQKEGXALPVQEFRRHINMGYDELGELLEKLARHGYIYSGRQGWVLKTGADSIELNELFKLFVYRPLPVERDHVNQAVDAVMMPCLQTLNMTLAEFDAQAKKQQQS

SEQ ID NO: 344 - protein, 408 aa, Neisseria
MTFLQCWQGSADNKICAFAWFVIRRFSEERVPQAAASMTFTTLLALVPVLTVMVAVASIFPVFDRWSDSFVSFVNQTIVPQGADMVFDYIDAFRDQANRLTAIGSVMLVVTSLMLIRTIDNAFNRIWRVNTQRPWMMQFLVYWALLTFGPLSLGVGISFMVGSVQDSVLSSGAQQWADALKTAARLAFMTLLLWGLYRFVPNRFVPARQAFVGALITAFCLETARFLFTWYMGNFDGYRSIYGAFAAVPFFLLWLNLLWTLVLGGAVLTSSLSYWQGEAFRRGFDSRGRFDDVLKILLLLDAAQKEGRTLSVQEFRRHINMGYDELGELLEKLARYGYIYSGRQGWVLKTGADSIELSELFKLFVYRPLPVERDHVNQAVDAVMTPCLQTLNMTLAEFDAQAKKQQQS

SEQ ID NO: 345 - protein, 408 aa, Neisseria
MTFLQRWQGLADNKICAFAWFVIRRFSEERVPQAAASMTFTTLLALVPVLTVMVAVASIFPVFDRWSDSFVSFVNQTIVPQGADMVFDYIDAFRDQANRLTAIGSVMLVVTSLMLIRTIDNAFNRIWRVNTQRPWMMQFLVYWALLTFGPLSLGVGISFMVGSVQDSVLSSGAQQWADALKTAARLAFMTLLLWGLYRFVPNRFVPARQAFVGALITAFCLETARFLFTWYMGNFDGYRSIYGAFAAVPFFLLWLNLLWTLVLGGAVLTSSLSYWQGEAFRRGFDSRGRFDDVLKILLLLDAAQKEGRTLSVQEFRRHINMGYDELGELLEKLARYGYIYSGRQGWVLKTGADSIELSELFKLFVYRPLPVERDHVNQAVDAVMTPCLQTLNMTLAEFDAQAKKQQQS

SEQ ID NO: 346 - protein, 75 aa, Neisseria
RHARRIRIDTAINPELEALAEHLHYQWQGFLWLSTDMRQEISALVILLQRTRRKWLDAHERQHLRQSLLETREHG

SEQ ID NO: 347 - protein, 375 aa, Neisseria
MNTSQRNRLVSRWLNSYERYRYRRLIHAVRLGGAVLFATASARLLHLQHGEWIGMTVFVVLGMLQFQGAIYSKAVERMLGTVIGLGAGLGVLWLNQHYFHGNLLFYLTVGTASALAGWAAVGKNGYVPMLAGLTMCMLIGDNGSEWLDSGLMRAMNVLIGAAIAIAAAKLLPLKSTLMWRFMLADNLADCSKMIAEISNGRRMTRERLEENMAKMRQINARMVKSRSHLAATSGESRISPAMMEAMQHAHRKIVNTTELLLTTAAKLQSPKLNGSEIRLLDRHFTLLQTDLQQTVALINGRHARRIRIDTAINPELEALAEHLHYQWQGFLWLSTNMRQEISALVILLQRTRRKWLDAHERQHLRQSLLETREHG

SEQ ID NO: 348 - protein, 375 aa, Neisseria
MNTSQRNRLVSRWLNSYERYRYRRLIHAVRLGGAVLFATASARLLHLQHGEWIGMTVFVVLGMLQFQGAIYSKAVERMLGTVIGLGAGLGVLWLNQHYFHGNLLFYLTVGTASALAGWAAVGKNGYVPMLAGLTMCMLIGDNGSEWFDSGLMRAMNVLIGAAIAIAAAKLLPLKSTLMWRFMLADNLTDCSKMIAEISNGRRMTRERLEENMAKMRQINARMVKSRSHLAATSGESRISPAMMEAMQHAHRKIVNTTELLLTTAAKLQSPKLNGSEIRLLDRHFTLLQTDLQQTVALINGRHARRIRIDTAINPELEALAEHLHYQWQGFLWLSTNMRQEISALVILLQRTRRKWLDAHERQHLRQSLLETREHS

SEQ ID NO: 349 - protein, 409 aa, Neisseria
MSGVRFPSPAPIPSTDPPSGSLCFFTFPLQTASDMNSSQRKRLSGRWLNSYERYRHRRLIHAVRLGGTVLFATALARLLHLQHGEWIGMTVFVVLGMLQFQGAIYSNAVERMLGTVIGLGAGLGVLWLNQHYFHGNLLFYLTIGTASALAGWAAVGKNGYVPMLAGLTMCMLIGDNGSEWLDSGLMRAMNVLIGAAIAIAAAKLLPLKSTLMWRFMLADNLADCSKMIAEISNGRRMTRERLEQNMVKMRQINARMVKSRSHLAATSGESRISPSMMEAMQHAHRKIVNTTELLLTTAAKLQSPKLNGSEIRLLDRHFTLLQTDLQQTAALINGRHARRIRIDTAINPELEALAEHLHYQWQGFLWLSTNMRQEISALVIPLQRTRRKWLDAHERQHLRQSLLETREHG

SEQ ID NO: 350 - protein, 375 aa, Neisseria
MNSSQRKRLSGRWLNSYERYRHRRLIHAVRLGGTVLFATALARLLHLQHGEWIGMTVFVVLGMLQFQGAIYSNAVERMLGTVIGLGAGLGVLWLNQHYFHGNLLFYLTIGTASALAGWAAVGKNGYVPMLAGLTMCMLIGDNGSEWLDSGLMRAMNVLIGAAIAIAAAKLLPLKSTLMWRFMLADNLADCSKMIAEISNGRRMTRERLEQNMVKMRQINARMVKSRSHLAATSGESRISPSMMEAMQHAHRKIVNTTELLLTTAAKLQSPKLNGSEIRLLDRHFTLLQTDLQQTAALINGRHARRIRIDTAINPELEALAEHLHYQWQGFLWLSTNMRQEISALVILLQRTRRKWLDAHERQHLRQSLLETREHG

SEQ ID NO: 351 - protein, 237 aa, Neisseria
  VARIANT (1)...(237): Xaa = Any Amino Acid
AEDTRVTAQLLSAYGIQGKLVSVREHNERQMADKIVGYLSDGMVVAQVSDAGTPAVCDPGAKLARRVREAGFKVVPVVGAXAVMAALSVAGVEGSDFYFNGFVPPKSGERRKLFAKWVRAAFPIVMFETPHRIGAALADMAELFPERRLMLAREITKTFETFLSGTVGEIQTALSADGDQSRGEMVLVLYPAQDEKHEGLSESAQNIMKILTAELPTKQAAELAAKITGEGKKALYD

SEQ ID NO: 352 - protein, 291 aa, Neisseria; identical to SEQ ID NO: 175

SEQ ID NO: 353 - protein, 300 aa, Neisseria; identical to SEQ ID NO: 177

SEQ ID NO: 354 - protein, 291 aa, Neisseria; identical to SEQ ID NO: 178

SEQ ID NO: 355 - protein, 1450 aa, Neisseria
  VARIANT (1)...(1450): Xaa = Any Amino Acid
MKTTDKRTTETHRKAPKTGRIRFXAAYLAICLSFGILPQAWAGHTYFGINYQYYRDFAENKGKFAVGAKDIEVYNKKGELVGKSMTKAPMIDFSVVSRNGVAALVGVQYIVSVAHNGGYNNVDFGAEGXNIXDQXRXTYKIVKRNNYKAGTKGHPYGGDYHMPRLHKXVTDAEPVEMTSYMDGRKYIDQNNYPDRVRIGAGRQYWRSDEDEPNNRESSYHIASXXXXXXXXXXXXXXXGSPMFIYDAQKQKWLINGVLQTGNPYIGKSNGFQLVRKDWFYDEIFAGDTHSVFYEPRQNGKYSFNDDNNGTGKINAKHEHNSLPNRLKTRTVQLFNVSLSETAREPVYHAAGGVNSYRPRLNNGENISFIDEGKGELILTSNINQGAGGLYFQGDFTVSPENNETWQGAGVHISEDSTVTWKVNGVANDRLSKIGKGTLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDKVTASLTKTDISGNVDLADHAHLNLTGLATLNGNLSANGDTRYTVSHNATQNGNXSLVXNAQATFNQATLNGNTSASGNASFNLSDHAVQNGSLTLSGNAKANVSHSALNGNVSLADKAVFHFESSRFTGQISGGKDTALHLKDSEWTLPSGXELGNLNLDNATITLNSAYRHDAAGAQTGSATDAPRRRSRRSRRSLLXVTPPTSVESRFNTLTVNGKLNGQGTFRFMSELFGYRSDKLKLAESSEGTYTLAVNNTGNEPASLEQLTVVEGKDNKPLSENLNFTLQNEHVDAGAWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLDRVFAEDRRNAVWTSGIRDTKHYRSQDFRAYRQQTDLRQIGMQKNLGSGRVGILFSHNRTENTFDDGIGNSARLAHGAVFGQYGIDRFYIGISAGAGFSSGSLSDGIGXKXRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 356 - protein, 1457 aa, Neisseria
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGRNPDQHRFTYKIVKRNNYKAGTKGHPYGGDYHMPRLHKFVTDAEPVEMTSYMDGRKYIDQNNYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPRQNGKYSFNDDNNGTGKINAKHEHNSLPNRLKTRTVQLFNVSLSETAREPVYHAAGGVNSYRPRLNNGENISFIDEGKGELILTSNINQGAGGLYFQGDFTVSPENNETWQGAGVHISEDSTVTWKVNGVANDRLSKIGKGTLHVQAKGENQGSISVGDGTVILDQQADDKGKKQAFSEIGLVSGRGTVQLNADNQFNPDKLYFGFRGGRLDLNGHSLSFHRIQNTDEGAMIVNHNQDKESTVTITGNKDIATTGNNNSLDSKKEIAYNGWFGEKDTTKTNGRLNLVYQPAAEDRTLLLSGGTNLNGNITQTNGKLFFSGRPTPHAYNHLNDHWSQKEGIPRGEIVWDNDWINRTFKAENFQIKGGQAVVSRNVAKVKGDWHLSNHAQAVFGVAPHQSHTICTRSDWTGLTNCVEKTITDDKVIASLTKTDISGNVDLADHAHLNLTGLATLNGNLSANGDTRYTVSHNATQNGNLSLVGNAQATFNQATLNGNTSASGNASFNLSDHAVQNGSLTLSGNAKANVSHSALNGNVSLADKAVFHFESSRFTGQISGGKDTALHLKDSEWTLPSGTELGNLNLDNATITLNSAYRHDAAGAQTGSATDAPRRRSRRSRRSLLSVTPPTSVESRFNTLTVNGKLNGQGTFRFMSELFGYRSDKLKLAESSEGTYTLAVNNTGNEPASLEQLTVVEGKDNKPLSENLNFTLQNEHVDAGAWRYQLIRKDGEFRLHNPVKEQELSDKLGKAEAKKQAEKDNAQSLDALIAAGRDAVEKTESVAEPARQAGGENVGIMQAEEEKKRVQADKDTALAKQREAETRPATTAFPRARRARRDLPQLQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTENTFDDGIGNSARLAHGAVFGQYGIDRFYIGISAGAGFSSGSLSDGIGGKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 357 - protein, 1449 aa, Neisseria
  VARIANT (1)...(1449): Xaa = Any Amino Acid
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGXNPDQHRFSYQIVKRNNYKPDNSHPYNGDXHMPRLHKFVTDAEPVEMTSDMRGNTYSDKEKYPERVRIGSGHHYWRYDDDKHGDLSYSGAWLIGGNTHMQGWGNNGVXSLSGDVRHANDYGPMPIAGAAGDSGSPMFIYDKTNNKWLLNGVLQTGYPYSGRENGFQLIRKDWFYDDIYRGDTHTVXFEPRSNGHFSFTSNNNGTGTVTETNEKVSNPKLKVQTVRLFDESLNETDKEPVYAAGGVNQYRPRLNNGENLSFIDYGNGKLILSNNINQGAGGLYFEGDFTVSPENNETWQGAGVHISEDSTVTWKVNGVANDRLSKIGKGTLHVQAKGENQGSISVGDGTVILDQQADDKGKKQAFSEIGLXSGRGTVQLNADNQFNPDKLYFGFRGGRLDLNGHSLSFHRIQNTDEGAMIXXHNATTTSTVTITGNESITQPSGKNINRLNYSKEIAYNGWFGEKDTTKTNGRLNLVYQPAAEDRTXLLSGGTNLNGNITQTNGKLFFSGRPTPHAYNHLGSGWSKMEGIPQGEIVWDNDWIXRTFKAENFHIQGGQAVISRNVAKVEGDXHLSNHAQAVFGVAPHQSHTICTRSDWTGLTNCVEXXITDDKVIASLTKTDXSGXVXLXXXXXXXLXGXAXLXGNLSANGDTRYTVSHNATQNGNLSLVGNAQATFNQATLNGNXSXSGNASFNLSNNAAQNGSLTLSDNAKANVSHSALNGNVSLADKAVFHFENSRFTGQLSGSKXTALHLKDSEWTLPSGTELGNLNLDNATITLNSAYRHDAAGAQTGXVSDTPRRRSRRSLLSVTPPTSVESRFNTLTVNGKLNXQGTFRFMSELFGYRSDKLKLAESSEGTYTLAVNNTGNEPVSLDQLTVVEGKDNKPLSENLNFTLQNEHVDAGAWRYQLIRKDGEFRLHNPVKEQELSDKLGKAEAKKQAEKDNAQSLDALIAAGRDAAEKTESVAEPARXAGGENVGIMQAEEEKKRVQADKDSALAKQREAETRPXTTAFPRARXARRDLPQPQPQPQPQPQPQRDLXSRYANSGLSEFSATLNSVFAVQDELDRVFAEDRRNAVWTSXIRXTKHYRSQDFRAYRQQTDLRQIGMQKNLGSGRVGILFSHNRTENXFDDGIGNSARLAHGAVFGQYGIGRFDIGISTGAGFSSGXLSDGIGGKIRRRVLHYGIQARYRAGFGGFGIEPYIGATRYFVQKADYRYENVNIATPGLAFNRYRAGIKADYSFKPAQHXSITPYXSLSYTDAASGKVRTRVNTAVLAQDFGKTRSAEWGVNAEIKGFTLSXHAAAAKGPQLEAQHSAGIKLGYRW

SEQ ID NO: 358 - protein, 1468 aa, Neisseria
MKTTDKRTTETHRKAPKTGRIRFSPAYLAICLSFGILPQARAGHTYFGINYQYYRDFAENKGKFAVGAKDIEVYNKKGELVGKSMTKAPMIDFSVVSRNGVAALAGDQYIVSVAHNGGYNNVDFGAEGSNPDQHRFSYQIVKRNNYKAGTNGHPYGGDYHMPRLHKFVTDAEPVEMTSYMDGWKYADLNKYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPHQNGKYFFNDNNNGAGKIDAKHKHYSLPYRLKTRTVQLFNVSLSETAREPVYHAAGGVNSYRPRLNNGENISFIDKGKGELILTSNINQGAGGLYFEGNFTVSPKNNETWQGAGVHISDGSTVTWKVNGVANDRLSKIGKGTLLVQAKGENQGSVSVGDGKVILDQQADDQGKKQAFSEIGLVSGRGTVQLNADNQFNPDKLYFGFRGGRLDLNGHSLSFHRIQNTDEGAMIVNHNQDKESTVTITGNKDITTTGNNNNLDSKKEIAYNGWFGEKDATKTNGGLNLNYPPEEADRTLLLSGGTNLNGNITQTNGKLFFSGRPTPHAYNHLGSGWSKMEGIPQGEIVWDNDWIDRTFKAENFHIQGGQAVVSRNVAKVEGDWHLSNHAQAVFGVAPHQSHTICTRSDWTGLTSCTEKTITDDKVIASLSKTDVRGNVSLADHAHLNLTGLATFNGNLVQAETRTIRLRANATQNGNLSLVGNAQATFNQATLNGNTSASDNASFNLSNNAVQNGSLTLSDNAKANVSHSALNGNVSLADKAVFHFENSRFTGKISGGKDTALHLKDSEWTLPSGTELGNLNLDNATITLNSAYRHDAAGAQTGSAADAPRRRSRRSLLSVTPPTSAESRFNTLTVNGKLNGQGTFRFMSELFGYRSGKLKLAESSEGTYTLAVNNTGNEPVSLEQLTVVEGKDNTPLSENLNFTLQNEHVDAGAWRYQLIRKDGEFRLHNPVKEQELSDKLGKAGETEAALTAKQAQLAAKQQAEKDNAQSLDALIAAGRNATEKAESVAEPARQAGGENAGIMQAEEEKKRVQADKDTALAKQREAETRPATTAFPRARRARRDLPQPQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTGNTFDDGIGNSARLAHGAVFGQYGIGRFDIGISAGAGFSSGSLSDGIRGKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 359 - protein, 140 aa, Neisseria
  VARIANT (1)...(140): Xaa = Any Amino Acid
KVWQFVEXPLRAVVPADSFEPTAQKLNLFKAGAATILFYEDQNVVKGLQEQFPAYAANFPVWADQANAMVQYAVWTTLAAVGVGANLQHYNPLPDAAIAKAWNIPENWLLRAQMVIGGIEGAAGEKTFEPVAERLKVFGA

SEQ ID NO: 360 - protein, 131 aa, Neisseria
LRAVVPADSFEPTAQKLNLFKAGAATILFYEDQNVVKGLQEQFPAYAANFPVWADQANAMVQYAVWTTLAAVGVGANLQHYNPLPDAAIAKAWNIPENWLLRAQMVIGGIEGAAGEKTFEPVAERLKVFGA

SEQ ID NO: 361 - protein, 201 aa, Neisseria
MTRQSLQQAAESRRSIYSLNKNLPVGKDEIVQIVEHAVLHTPSSFNSQSARVVVLFGEEHDKVWQFVEDALRAVVPADSFEPTAQKLNLFKAGAATILFYEDQNVVKGLQEQFPAYAANFPVWADQANAMVQYAVWTTLAAVGVGANLQHYNPLPDAAIAKAWNIPENWLLRAQMVIGGIEGAAGEKTFEPVAERLKVFGA

SEQ ID NO: 362 - protein, 174 aa, Neisseria
MAVASNVSLDMSNPTVLRMGLPLYIASLRRGAIYKVWQFVEDALRAVVPADSFEPTAQKLKLFKAGAATILFYEDQNVVKGLQEQFPAYAANFPVWADQANAMVQYAVWTTLAAVGAGANLQHYNPLPDVAIAKAWNIPENWLLRAQMVIGGIEGAAGEKVFEPVAERLKVFGA

SEQ ID NO: 363 - protein, 211 aa, Neisseria
  VARIANT (1)...(211): Xaa = Any Amino Acid
GYNYLFARGSRIANYQINGIPVADALADTGNANTAAYERVEVVRGVAGLLDGTGEPSATVNLVRKRLTRKPLFEVRAEAGNRKHFGLDADVSGSLNTEXXLRGRLVSTFGRGDSWRRRERSRXAELYGILEYDIAPQTRVHAXMDYQQAKETADAPLSYAVYDSQGYATAFGPKDNPATNWANSHHRALNLFAGIEHRFNQDWKLKAEYDY

SEQ ID NO: 364 - protein, 725 aa, Neisseria
MTRFKYSLLFAALLPVYAQADVSVSDDPKPQESTELPTITVTADRTASSNDGYTVSGTHTPLGLPMTLREIPQSVSVITSQQMRDQNIKTLDRALLQATGTSRQIYGSDRAGYNYLFARGSRIANYQINGIPVADALADTGNANTAAYERVEVVRGVAGLLDGTGEPSATVNLVRKRLTRKPLFEVRAEAGNRKHFGLDADVSGSLNTEGTLRGRLVSTFGRGDSWRRRERSRDAELYGILEYDIAPQTRVHAGMDYQQAKETADAPLSYAVYDSQGYATAFGPKDNPATNWANSRHRALNLFAGIEHRFNQDWKLKAEYDYTRSRFRQPYGVAGVLSIDHNTAATDLIPGYWHADPRTHSASVSLIGKYRLFGREHDLIAGINGYKYASNKYGERSIIPNAIPNAYEFSRTGAYPQPASFAQTIPQYGTRRQIGGYLATRFRAADNLSLILGGRYTRYRTGSYDSRTQGMTYVSANRFTPYTGIVFDLTGNLSLYGSYSSLFVPQSQKDEHGSYLKPVTGNNLEAGIKGEWLEGRLNASAAVYRARKNNLATAAGRDPSGNTYYRAANQAKTHGWEIEVGGRITPEWQIQAGYSQSKTRDQDGSRLNPDSVPERSFKLFTAYHFAPEAPSGWTIGAGVRWQSETHTDPATLRIPNPAAKARAADNSRQKAYAVADIMARYRFNPRAELSLNVDNLFNKHYRTQPDRHSYGALRTVNAAFTYRFK

SEQ ID NO: 365 - protein, 725 aa, Neisseria
MTRFKYSLLFAALLPVYAQADVSVSDDPKPQESTELPTITVTADRTASSNDGYTVSGTHTPLGLPMTLREIPQSVSVITSQQMRDQNIKALDRALLQATGTSRQIYGSDRAGYNYLFARGSRIANYQINGIPVADALADTGNANTAAYERVEVVRGVAGLLDGTGEPSATVNLVRKRPTRKPLFEVRAEAGNRKHFGLGADVSGSLNAEGTLRGRLVSTFGRGDSWRQRERSRDAELYGILEYDIAPQTRVHAGMDYQQAKETADAPLSYAVYDSQGYATAFGPKDNPATNWANSRHRALNLFAGIEHRFNQDWKLKAEYDYTRSRFRQPYGVAGVLSIDHNTAATDLIPGYWHADPRTHSASVSLIGKYRLFGREHDLIAGINGYKYASNKYGERSIIPNAIPNAYEFSRTGAYPQPASFAQTIPQYGTRRQIGGYLATRFRAADNLSLILGGRYSRYRTGSYDSRTQGMTYVSANRFTPYTGIVFDLTGNLSLYGSYSSLFVPQSQKDEHGSYLKPVTGNNLEAGIKGEWLEGRLNASAAVYRARKNNLATAAGRDPSGNTYYRAANQAKTHGWEIEVGGRITPEWQIQAGYSQSKTRDQDGSRLNPDSVPERSFKLFTAYHFAPEAPSGWTIGAGVRWQSETHTDPATLRIPNPAAKARAADNSRQKAYAVADIMARYRFNPRAELSLNVDNLFNKHYRTQPDRHSYGALRTVNAAFTYRFK

SEQ ID NO: 366 - protein, 623 aa, Neisseria
SAVDACRIPGYNYLFARGSRIANYQINGIPVADALADTGNANTAAYERVEVVRGVAGLPDGTGEPSATVNLVRKHPTRKPLFEVRAEAGNRKHFGLGADVSGSLNAEGTLRGRLVSTFGRGDSWRQLERSRDAELYGILEYDIAPQTRVHAGMDYQQAKETADAPLSYAVYDSQGYATAFGPKDNPATNWSNSRNRALNLFAGIEHRFNQDWKLKAEYDYTRSRFRQPYGVAGVLSIDHSTAATDLIPGYWHADPRTHSASMSLTGKYRLFGREHDLIAGINGYKYASNKYGERSIIPNAIPNAYEFSRTGAYPQPSSFAQTIPQYDTRRQIGGYLATRFRAADNLSLILGGRYSRYRAGSYNSRTQGMTYVSANRFTPYTGIVFDLTGNLSLYGSYSSLFVPQLQKDEHGSYLKPVTGNNLEADIKGEWLEGRLNASAAVYRARKNNLATAAGRDQSGNTYYRAANQAKTHGWEIEVGGRITPEWQIQAGYSQSKPRDQDGSRLNPDSVPERSFKLFTAYHLAPEAPSGRTIGAGVRRQGETHTDPAALRIPNPAAKARAVANSRQKAYAVADIMARYRFNPRTELSLNVDNLFNKHYRTQPDRHSYGALRTVNAAFTYRFK

SEQ ID NO: 367 - protein, 725 aa, Neisseria
MTRFKYSLLFAALLPVYAQADVSVSDDPKPQESTELPTITVTADRTASSNDGYTVSGTHTPFGLPMTLREIPQSVSVITSQQMRDQNIKTLDRALLQATGTSRQIYGSDRAGYNYLFARGSRIANYQINGIPVADALADTGNANTAAYERVEVVRGVAGLPDGTGEPSATVNLVRKHPTRKPLFEVRAEAGNRKHFGLGADVSGSLNAEGTLRGRLVSTFGRGDSWRQLERSRDAELYGILEYDIAPQTRVHAGMDYQQAKETADAPLSYAVYDSQGYATAFGPKDNPATNWSNSRNRALNLFAGIEHRFNQDWKLKAEYDYTRSRFRQPYGVAGVLSIDHSTAATDLIPGYWHADPRTHSASMSLTGKYRLFGREHDLIAGINGYKYASNKYGERSIIPNAIPNAYEFSRTGAYPQPSSFAQTIPQYDTRRQIGGYLATRFRAADNLSLILGGRYSRYRAGSYNSRTQGMTYVSANRFTPYTGIVFDLTGNLSLYGSYSSLFVPQLQKDEHGSYLKPVTGNNLEADIKGEWLEGRLNASAAVYRARKNNLATAAGRDQSGNTYYRAANQAKTHGWEIEVGGRITPEWQIQAGYSQSKPRDQDGSRLNPDSVPERSFKLFTAYHLAPEAPSGRTIGAGVRRQGETHTDPAALRIPNPAAKARAVANSRQKAYAVADIMARYRFNPRTELSLNVDNLFNKHYRTQPDRHSYGALRTVNAAFTYRFK

SEQ ID NO: 368 - protein, 122 aa, Neisseria
  VARIANT (1)...(122): Xaa = Any Amino Acid
MRTAVVLLLIMPMAASSAMMPEMVCAGVSPGTAIISKPTEQTAVMASSLSSVSTPASAAAIIPSSSETGINAPLKPPTALEAIMPPFFTASFSNAKAAVVPCVPQTLKPIXSRMRATXSPTG

SEQ ID NO: 369 - protein, 307 aa, Neisseria
  VARIANT (1)...(307): Xaa = Any Amino Acid
MRTAVVLLLIMPMAASSAMMPEMVCAGVSPGTAIISKPTEQTAVMASSLSSVSTPASAAAIIPSSSETGINAPLKPPTALEAIMPPFFTASFSNAKAAVVPCVPQTLKPISSRMRATESPTAGVGASDKSRIPNGIFSIFEASRPMSSPTRVILKAVFFTTSATSVNVVASEFSNAAFTTPGPDTPTLITASASPEPXNAPAINGLSSTALQNTTILAQPKPSGVISAVRLTVSPASLTASILIPARVLPILMELHTISVVFIASGMERINTSSEGDIPFCTNAEKPPIKDTPMALAALSKVCATLT

SEQ ID NO: 370 - protein, 307 aa, Neisseria
  VARIANT (1)...(307): Xaa = Any Amino Acid
MRTAVVLLLIMPMAASSAMMPEMVCAGVSPGTAIISXPTEQTAVIASSLSNVSTPASAAAIIPSSSXTGINAPLKPPTALEAIMPPFFTASFSNAKAAVVPCVPQTLKPISSRMRATESPTAGVGASDKSRIPNGIFSIFEASRPMSSPTRVILKAVFFTTSATSVNVVASEFSNAAFTTPGPDTPTLITASASPEPXNAPAIXGLSSXALQNTTILAQPKPSSVISXVRLMVSPASLTASILIPARVLPILMELHTISVVFIASGMERXNTSSEGDIPFCTSAEKPPIKDTPMALAALSKVCATLT

SEQ ID NO: 371 - protein, 307 aa, Neisseria
MRTAVVLLLIMPMAASSAMMPEMVCAGVSPGTAIMSKPTEQTAVMASSLSSVNTPASAAAIIPSSSETGINAPLKPPTALEAIMPPFFTASFSNAKAAVVPCVPQTLKPISSRMRATESPTAGVGASDKSRMPNGIFSIFEASRPMSSPTRVILKAVFFTTSATSVRLTASEFSSAALTTPGPDTPTLITASASPEPWNAPAINGLSSTALQNTTILAQPKPSGVISAVRLMVSPASLTASILIPARVLPILMELHTISVVFIASGTERINTSSEGDIPFCTSAEKPPIKDTPMALAALSKVCATLT

SEQ ID NO: 372 - protein, 60 aa, Neisseria
TDVQKELVGEQRKWAQEKISNCRQAAAQADRQEYAEYLKLQCDTRMTRERIQYLRGYSID

SEQ ID NO: 373 - protein, 338 aa, Neisseria
MYRKLIALPFALLLAACGREEPPKALECANPAVLQGIRGNIQETLTQEARSFAREDGRQFVDADKIIAAAYGLAFSLEHASETQEGGRTFCIADLNITVPSETLADAKANSPLLYGETALSDIVRQKTGGNVEFKDGVLTAAVRFLPVKDGQTAFVDNTVGMAAQTLSAALLPYGVKSIVMIDGKAVKKEDAVRILSGKAREEEPSKPTPEDILEHNAAGGDAGVPQAAEGAPEPEILHPDDGERADTVTVSRGEVEEARVQNQRAESEITKLWGGLDTDVQKELVGEQRKWAQEKISNCRQAAAQADRQEYAEYLKLQCDTRMTRERIQYLRGYSID

SEQ ID NO: 374 - protein, 338 aa, Neisseria
  VARIANT (1)...(338): Xaa = Any Amino Acid
MYRKLIALPFALLLAACGREEPPKALECANPAVLQXIRXNIQETLTQEARSFAREDXXQFVDADXIIAAAXXXXXSLEHASETQEGGRTFCXADLNITVPSETLADAKANSPLLYGETALSDIVRQKTGGNVEFKDGVLTAAVRFLPVKDGQXAFVDNTVGMAAQTLSAALLPYGVKSIVMIDGKAVKKEDAVRIXSXXAREXEPSKXXPEDILEHNAAGGDADVPQAGEDAPEPEILHPDDGERADTVTVSRGEVEEARVQNQRAESEITKLWGGLDTDVQKELVGEXRKWAQEKISNCRQAAAQADRQEYAEYLKLQCDTRMTRERIQYLRGYSID

SEQ ID NO: 375 - protein, 338 aa, Neisseria
MYRKLIALPFALLLAACGREEPPKALECANPAVLQDIRGSIQETLTQEARSFAREDGRQFVDADKIIAAAYGLAFSLEHASETQEGGRTFCIADLNITVPSETLADAEANSPLLYGETSLADIVQQKTGGNVEFKDGVLTAAVRFLPAKDARTAFIDNTVGMATQTLSAALLPYGVKSIVMIDGKAVTKEDAVRVLSGKAREEEPSKPTPEDILEHNAAGGDAGVPQAAEGAPEPEILHPDDVERADTVTVSRGEVEEARVQNQRAESEITKLWGGLDTDVQKELVGEQRKWAQEKISNCRQAAAQADRQEYAEYLKLQCDTRMTRERIQYLRGYSID

SEQ ID NO: 376 - protein, 502 aa, Neisseria
  VARIANT (1)...(502): Xaa = Any Amino Acid
MQLIDYSHSFFSVVPPFLALALAVITRRVLLSLGIGILXXVAFLVGGNPVDGLTHLKDMVVGLAWSDXDWSLGKPKILVFXILLGIFTSLLTYSGSNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTSLVFGGTCGVFAVVLCTLGTIKTADYPKAVWQGAKSMFGAIAILILAWLISTVVGEMHTGDYLSTLVAGNIHPGFLPVILFLLASVMAFATGTSWGTFGIMLPIAAAMAVKVEPALIIPCMSAVMAGAVCGDHCSPISDTTILSSTGARCNHIDHVTSQLPYALTVAAAAASGYLALGLTKSALLGFGTTGIVLAVLIFLLKDKK

SEQ ID NO: 377 - protein, 506 aa, Neisseria
MQLIDYSHSFFSVVPPFLALALAVITRRVLLSLGIGILVGVAFLVGGNPVDGLTHLKDMVVGLAWSDGDWSLGKPKILVFLILLGIFTSLLTYSGSNQAFADWAKRHIKNRRGAKMLTACLVFVTFIDDYFHSLAVGAIARPVTDKFKVSRTKLAYILDSTAAPMCVLMPVSSWGASIIATLAGLLVTYKITEYTPMGTFVAMSLMNYYALFALIMVFVVAWFSFDIGSMARFEQAALNEAHDETAVSDATKGRVYALIIPVLALIASTVSAMIYTGAQASETFSILGAFENTDVNTSLVFGGTCGVLAVVLCTLGTIKTADYPKAVWQGAKSMFGAIAILILAWLISTVVGEMHTGDYLSTLVAGNIHPGFLPVILFLLASVMAFATGTSWGTFGIMLPIAAAMAVKVEPALIIPCMSAVMAGAVCGDHCSPISDTTILSSTGARCNHIDHVTSQLPYALTVAAAAASGYLALGLTKSALLGFGTTGIVLAVLIFLLKDKKRANA

SEQ ID NO: 378 - protein, 506 aa, Neisseria
  VARIANT (1)...(506): Xaa = Any Amino Acid
MQLIDYSHSFFSVVPPFLALALAVITRRVLLSLGIGILVGVAFLVGGNPVDGLTHLKDMVVGLAWSDGDWSLGKPKXLVFLILLGIFTSLLTYSGSNQAFADWAKRHIKNRRGAKMLTACLVFVTFIDDYFHSLAVGAXARPVTDKFKVSRAKLAYILDSTAAPMCVLMPVSSWGASIIATLAGLLVTYKITEYTPMGTFVAMSLMNYYALFALIMVFVVAWFSFDIGSMARFEQAALNEAHDETAVSDGSWGRVYALIIPVLALIASTVSAMIYTGAQASETFSILGAFENTDVNTSLVFGGTCGVLAVVLCTLGTIKIADYPKAVWQGAKSMFGAIAILILAWLISTVVGEMHTGDYLSTLVAGNIHPGFLXVILFLLASVMAFATGTSWGTFGIMLPIAAAMAVKVDPSLIIPCMSAVMAGAVCGDHCSPISDTTILSSTGARCNHIDHVTSQLPYALTVAAAAASGYLALGLTKSALLGFGXTGIVLAVLIFLLKDKKRANA

SEQ ID NO: 379 - protein, 506 aa, Neisseria
MQLIDYSHSFFSVVPPFLALALAVITRRVLLSLGIGILVGVAFLVGGNPVDGLTHLKDMVVGLAWADGDWSLGKPKILVFLILLGIFTSLLTYSGSNQAFADWAKRHIKNRCGAKMLTACLVFVTFIDDYFHSLAVGAIARPVTDKFKVSRAKLAYILDSTASPMCVLMPVSSWGASIIATLAGLLVTYKITEYTPMGTFVAMSLMNYYALFALIMVFVVAWFSFDIGSMARFEQAALNEAQDETAASDATKGRVYALIIPVLALIASTVSAMIYTGAQASETFSILGAFENTDVNTSLVFGGTCGVLAVVLCTFGTIKTADYPKAVWQGAKSMFGAIAILILAWLISTVVGEMHTGDYLSTLVAGNIHPGFLPVILFLLASVMAFATGTSWGTFGIMLPIAAAMAVKVEPALIIPCMSAVMAGAVCGDHCSPISDTTILSSTGARCNHIDHVTSQLPYALTVAAAAASGYLALGLTKSALLGFGTTGIVLAVLIFLLKDKKRADV

SEQ ID NO: 380 - protein, 82 aa, Neisseria
  VARIANT (1)...(82): Xaa = Any Amino Acid
KQWYADXSIKTEMVMVNDEPAKILTWDESGRLLSELSIRHHQRNGVVLEWYEDGSKKSEXVYQDDKLVRKTQWDKDGYLIEP

SEQ ID NO: 381 - protein, 245 aa, Neisseria
MKKLSRIVFSTVLLGFSAALPAQTYSVYFNQNGKLTATMSSAAYIRQYSVVAGIAHAQDFYYPSMKKYSEPYIVASTQIKSFVPTLQNGMLILWHFNGQKKMAGGFSKGKPDGEWVNWYPNGKKSAVMPYKNGLSEGTGYRYYRNGGKESEIQFKQNKANGVWKQWYADGSIKTEMVMVNDEPAKILTWDESGRLLSELSIRHHQRNGVVLEWYEDGSKKSEAVYQDDKLVRKTQWDKDGYLIEP

SEQ ID NO: 382 - protein, 245 aa, Neisseria
  VARIANT (1)...(245): Xaa = Any Amino Acid
MKKLSRIVFSTVLLGFSAALPAQXYSVYFNQNGKLTATXSSAAYIRQYSVAEGIAHAQXFXYPSMKKYSEPYIVASTQIKSFVPTLQNGMLILWHFXGQKKMAGGFSKGKPDGEWVNWYPNGKKSAVMPYKNGLSEGTGXRYYRNGGKESEIQFKQNKANGVWKQWYADGNIKTEMVMVNDEPAKILTWDESGRLLSELSIHHHXRNGVVLEWYEDGSKKXEAVYQDDKLVRKTQWDXDGYLIEP

SEQ ID NO: 383 - protein, 245 aa, Neisseria
MKKLSRIVFSIVLLGFSAALPAQTYSVYFNQNGKLTATMSSAAYIRQYSVAAGIAHAQDFYYPSMKKYSEPYIVASTQIKSFVPTLQNGMLILWHFNGQKKMAGGFSKGKPDGEWVNWYPNGKKSAVMPYKNGLSEGTGYRYYRNGGKESEIQFKQNKANGVWKQWYADGSIKTEMVMVNDEPAKILTWDESGRLLSELSIRHHKRNGVVLEWYEDGSKKSEAVYQDDKLVRKTQWDKDGYLIEP

SEQ ID NO: 384 - protein, 172 aa, Neisseria
  VARIANT (1)...(172): Xaa = Any Amino Acid
MKFTKHPVWAMAFRPFYSLAALYGALSVLLWGFGYTGTHXLSGFYWHAHEMIWGYAGLVVIAFLLTAVATWTGQPPTRGGVLVGLTIFWLAARIAAFIPGWGASASGILGTLFFWYGAVCMALPVIRSQNQRNYVAVFALFVLGGTHAAFHVQLHNGNLGGLLSGLQSGLVM

SEQ ID NO: 385 - protein, 384 aa, Neisseria
MKFTKHPVWAMAFRPFYSLAALYGALSVLLWGFGYTGTHELSGFYWHAHEMIWGYAGLVVIAFLLTAVATWTGQPPTRGGVLVGLTIFWLAARIAAFIPGWGASASGILGTLFFWYGAVCMALPVIRSQNQRNYVAVFALFVLGGTHAAFHVQLHNGNLGGLLSGLQSGLVMVSGFIGLIGTRIISFFTSKRLNVPQIPSPKWVAQASLWLPMLTAMLMAHGVLAWLSAVFAFAAGVIFTVQVYRWWYKPVLKEPMLWILFAGYLFTGLGLIAVGASYFKPAFLNLGVHLIGVGGIGVLTLGMMARTALGHTGNPIYPPPKAVPVAFWLMMAATAVRMVAVFSSGTAYTHSIRTSSVLFALALLVYAWKYIPWLIRPRSDGRPG

SEQ ID NO: 386 - protein, 384 aa, Neisseria
MKFTKHPVWAMAFRPFYSLAALYGALSVLLWGFGYTGTHELSGFYWHAHEMIWGYAGLVVIAFLLTAVATWTGQPPTRGGVLVGLTIFWLAARIAAFIPGWGASASGILGTLFFWYGAVCMALPVIRSQNQRNYVAVFALFVLGGTHAAFHVQLHNGNLGGLLSGLQSGLVMVSGFIGLIGTRIISFFTSKRLNVPQIPSPKWVAQASLWLPMLTAMLMAHGVMPWLSAAFAFAAGVIFTVQVYRWWYKPVLKEPMLWILFAGYLFTGLGLIAVGASYFKPAFLNLGVHLIGVGGIGVLTLGMMARTALGHTGNPIYPPPKAVPVAFWLMMAATAVRMVAVFSSGTAYTHSIRTSSVLFALALLVYAWKYIPWLIRPRSDGRPG

SEQ ID NO: 387 - protein, 271 aa, Neisseria
MKFTKHPVWAMAFRPFYSLAALYGALSVLLWGFGYTGTHELSGFYWHAHEMIWGYAGLVVIAFLLTAVATWTGQPPTRGGVLVGLTAFWLAARIAAFIPGWGAAASGILGTLFFWYGAVCMALPVIRSQNRRNYVAVFAIFVLGGTHAAFHVQLHNGNLGGLLSGLQSGLVMVWGFIGLIGMKIISFFTSKRLKLPQIPSPKWVAHASLWLPMLNAILMAHRVMPWLSAAFPFAAGVIFTVQVYAGGITPIEETSCGSVAGICYRLGNSSG

SEQ ID NO: 388 - protein, 384 aa, Neisseria
MKFTKHPVWAMAFRPFYSLAALYGALSVLLWGFGYTGTHELSGFYWHAHEMIWGYAGLVVIAFLLTAVATWTGQPPTRGGVLVGLTAFWLAARIAAFIPGWGAAASGILGTLFFWYGAVCMALPVIRSQNRRNYVAVFAIFVLGGTHAAFHVQLHNGNLGGLLSGLQSGLVMVSGFIGLIGMRIISFFTSKRLNVPQIPSPKWVAQASLWLPMLTAILMAHGVMPWLSAAFAFAAGVIFTVQVYRWWYKPVLKEPMLWILFAGYLFTGLGLIAVGASYFKPAFLNLGVHLIGVGGIGVLTLGMMARTALGHTGNSIYPPPKAVPVAFWLMMAATAVRMVAVFSSGTAYTHSIRTSSVLFALALLVYAWKYIPWLIRPRSDGRPG

SEQ ID NO: 389 - protein, 190 aa, Neisseria
  VARIANT (1)...(190): Xaa = Any Amino Acid
MPSEGSDGXGXGEXEXVAHAQXDFVGFEAGVFQASPVVVTVSGVXXQLGXDVETDTGDDTKTXAADXVAFVIGRFXGXXLYXXAXXXXAXXWXXXXSRGFXXHRMNLMFNVSVGDARADIGFEFIVEFEIVNGGQAERRNGVEAAVSLMFCLGFFVVVVYLFSNFFSRRITFFPFSVTGIICRYSPAAEI

SEQ ID NO: 390 - protein, 360 aa, Neisseria
MPSETVGSIVNVGVDESVGFSPPFPSIQHFYRFHRIHRIRLFRPPGPMQLNRHSHGSGNLGRGVWATVLSDKFPCGQVRIPACAGMTNFEIAVLSGMTVRVFYCARPAPVNGGRLKMPSEGSDGIGIGESEAVAHAQRGFVGFEAGVFQASPVVVAVAGVQGQAGRDVYAHARHRAEAQAAAAVAFLIGVFLRMSVRINRNCCVSITRVGGKSTCYFFSRIDAVSDVSVGDARTDIGFEFVVEFEIVNGGQAERRNGVECAVFLMFRLLVFYVKLVAAKSFIILSFQLFYVHGIFIVVPFPVTGIIRGDAPAAEVVADRHPGVDGMRTDVSEIIAYRAYFVFAWSGWFRIIVGNAFGGVG

SEQ ID NO: 391 - protein, 145 aa, Neisseria
  VARIANT (1)...(145): Xaa = Any Amino Acid
MFAFLEAFFVEYGYAAVFFVLVICGFGVPIPEDLTLVTGGVISGMGYTNPHIMFAVGMLGVLVGDGIMFAAGRIWGQXXLXFXPIAXIMTPXRYEQVQEKFDKYGNWVLFVARFLPGLRTAVFVTAGISRKVSYLRFIIMDGLAA

SEQ ID NO: 392 - protein, 227 aa, Neisseria
MFAFLEAFFVEYGYAAVFFVLVICGFGVPIPEDLTLVTGGVISGMGYTNPHIMFAVGMLGVLVGDGIMFAAGRIWGQKILRFKPIARIMTPKRYEQVQEKFDKYGNWVLFVARFLPGLRTAVFVTAGISRKVSYLRFIIMDGLAALISVPIWIYLGEYGAHNIDWLMAKMHSLQSGIFVILGIGATVVAWIWWKKRQRIQFYRSKLKEKRAQRKAAKAAKKAAQSKQ

SEQ ID NO: 393 - protein, 227 aa, Neisseria
MFALLEAFFVEYGYAAVFFVLVICGFGVPIPEDLTLVTGGVISGMGYTNPHIMFAVGMLGVLVGDGIMFAAGRIWGQKILKFKPIARIMTPKRYAQVQEKFDKYGNWVLFVARFLPGLRTAVFVTAGISRKVSYLRFLIMDGLAALISVPVWIYLGEYGAHNIDWLMAKMHSLQSGIFIALGVLAAALAWFWWRKRRHYQLYRAQLSEKRAKRKAEKAAKKAAQKQQ

SEQ ID NO: 394 - protein, 122 aa, Neisseria
YPVLFVARFLPGLRTAVFVTAGISRKVSYLRFLIMDGLAALISVPVWIYLGEYGAHNIDWLMAKMHSLQSGIFIALGVLAAALAWFWWRKRRHYQLYRAQLSEKRAKRKAEKAAKKAAQKQQ

SEQ ID NO: 395 - protein, 227 aa, Neisseria
MFALLEAFFVEYGYAAVFFVLVICGFGVPIPEDLTLVTGGVISGMGYTNPHIMFAVGMLGVLAGDGVMFAAGRIWGQKILKFKPIARIMTPKRYAQVQEKFDKYGNWVLFVARFLPGLRTAVFVTAGISRKVSYLRFLIMDGLAALISVPVWIYLGEYGAHNIDWLMAKMHSLQSGIFIALGVLAAALAWFWWRKRRHYQLYRAQLSEKRAKRKAEKAAKKAAQKQQ

SEQ ID NO: 396 - protein, 147 aa, Neisseria
MKKLLAAVMMAGLAGAVSAAGVHVEDGWARTTVEGMKIGGAFMKIHNDEAKQDFLLGGSSPVADRVEVHTHINDNGVMRMREVEGGVPLEAKSVTELKPGSYHVMFMGLKKQLKEGDKIPVTLKFKNAKAQTVQLEVKIAPMPAMNH

SEQ ID NO: 397 - protein, 157 aa, Neisseria
MKKLLAAVMMAGLAGAVSAAGVHVEDGWARTTVEGMKIGGAFMKIHNDEAKQDFLLGGSSPVADRVEVHTHINDNGVMRMREVEGGVPLEAKSVTELKPGSYHVMFMGLKKQLKEGDKIPVTLKFKNAKAQTVQLEVKIAPMPAMNHGHHHGEAHQH

SEQ ID NO: 398 - protein, 157 aa, Neisseria
  VARIANT (1)...(157): Xaa = Any Amino Acid
MKXLLAAVMMAGLAGAVSAAGIHVEDGWARTTVEGMKMGGAFMKIHNDEAKQDFLLGGSSPVADRVEVHTHINDNGVMRMREVEGGVPLEAKSVTELKPGSYHVMFMGXKKQLKXGDKIPVTLKFKNAKAQTVQLEVKTAPMSAMDHGHHHGEAHQH

SEQ ID NO: 399 - protein, 86 aa, Neisseria
INDNGVMRMREVKGGVPLEAKSVTELKPGSYHVMFMGLKKQLKEGDKIPVTLKFKNAKAQTVQLEVKTAPMSAMNHGHHHGEAHQH

SEQ ID NO: 400 - protein, 157 aa, Neisseria
MKKLLAAVMMAGLAGAVSAAGVHVEDGWARTTVEGMKMGGAFMKIHNDEAIQDFVLGGSMPVADRVEVHTHINDNGVMRMREVKGGVPLEAKSVTELKPGSYHVMFMGLKKQLKEGDKIPVTLKFKNAKAQTVQLEVKTAPMSAMNHGHHHGEAHQH

SEQ ID NO: 401 - protein, 233 aa, Neisseria
  VARIANT (1)...(233): Xaa = Any Amino Acid
MTVTAAEGGKAAKALKKYLITGILVWLPIAVTVWVVSYIVSASDQLVNLLPKQWRPQYVLGFNIPGLGVIVAIAVLFVTGLFAANVLGRQILAAWDSLLGRIPVVKSIYSSVKKVSEYVLSDSSRSFKTPVLVPFPQPGIWTIAFVSGQVSNAVKAALPXDGDYLSVYVPTTPNPTGGYYIMVKKSDVRELDMSVDEXLKYVISLGMVIPDDLPVKTLAXPMPSEKADLPEQQ

SEQ ID NO: 402 - protein, 233 aa, Neisseria
  VARIANT (1)...(233): Xaa = Any Amino Acid
MTEXAAEGGKAAKALKKYLITGILVWLPIAVTVWVVSYIVSASDQLVNLLPKQWRPQYVLGFNIPGLGVIVAIAVLFVTGLFAANVLGRQILAAWDSLLGRIPVVKSIYSSVKKVSESLLSDSSRSFKTPVLVPFPQPGIWTIAFVSGQVSNAVKAALPKDGDYLSVYVPTTPNPTGGYYIMVKKSDVRELDMSVDEALKYVISLGMVIPDDLPVKTLAGPMPSEKADLPEQQ

SEQ ID NO: 403 - protein, 233 aa, Neisseria
  VARIANT (1)...(233): Xaa = Any Amino Acid
MTEPAAEGGKAAKALKKYLITGILVWLPIAVTVWVVSYIVSASDQLVNLLPKQWRPQYVLGFNIPGLGVIVAIAVLFVTGLFAANVLGRQILAAWDSLLGRIPVVKSIYSSVKKVSXSLLSDSSRSFKTPVLVPFPQSGIWTIAFVSGQVSNAVKAALPKDGDYLSVYVPTTPNPTGGYYIMVKKSDVRELDMSVDEALKYVISLGMVIPDDLPVKTLAGPMPSEKADLPEQQ

SEQ ID NO: 404 - protein, 233 aa, Neisseria
  VARIANT (1)...(233): Xaa = Any Amino Acid
MTEPAAEGGKAAKALKKYLITGILVWLPIAVTVWVVSYIVSASDQLVNLLPKQWRPQYVLGFNIPGLGVIVAIAVLFVTGLFAANVLGRQILAAWDSLLXRIPVVKSIYSSVKKVSESLLSDSSRSFKTPVLVPFPQSGIWTIAFVSGQVSNAVKAALPQDGDYLSVYVPTTPNPTGGYYIMVKKSDVRELDMSVDEALKYVISLGMVIPDDLPVKTLAGPMPPEKAELPEQQ

SEQ ID NO: 405 - protein, 233 aa, Neisseria
MTEPAAEGGKAAKALKKYLITGILVWLPIAVTVWVVSYIVSASDQLVNLLPKQWRPQYVLGFNIPGLGVIVAIAVLFVTGLFAANVLGRQILAAWDSLLGRIPVVKSIYSSVKKVSESLLSDSSRSFKTPVLVPFPQSGIWTIAFVSGQVSNAVKAALPQDGDYLSVYVPTTPNPTGGYYIMVKKSDVRELDMSVDEALKYVISLGMVIPDDLPVKTLAGPMPPEKAELPEQQ

SEQ ID NO: 406 - protein, 386 aa, Neisseria
  VARIANT (1)...(386): Xaa = Any Amino Acid
MKTVVWIVVLFAAAVGLALASGIYTGDVYIVLGQTMLRINLHAFVLGSLIAVVVWYFLFKFIIGVLNIPEKMQRFGSARKGXKXXLALNKAGLAYFEGRFEKAELEASRVLVNKVGRDNRTLALMLXAHAAGQMENIXXRDRYLAEIAKLPEKQQLSRYLLLAESALNRRDYEAAEANLHAAAKMNANLTRLVRLXIRYAFDRGDALQVLAKTEKLSKAGALGKSEMERYQNWAYRRQLADAADAAALKTCLKRIPDSLKNGELSVSVAEKYERLGLYADAVKWVKQHYPXNRRPELLEAFVESVRFLGEREQQKAIDFADAWLKEQPDNALLLMYLGRLAFGRKLWGKAKGYLEASIALKPSISARLVLTKVFDEIGEPQKAEAH

SEQ ID NO: 407 - protein, 407 aa, Neisseria
MKTVVWIVVLFAAAVGLALASGIYTGDVYIVLGQTMLRINLHAFVLGSLIAVVVWYFLFKFIIGVLNIPEKMQRFGSARKGRKAALALNKAGLAYFEGRFEKAELEASRVLVNKEAGDNRTLALMLGAHAAGQMENIELRDRYLAEIAKLPEKQQLSRYLLLAESALNRRDYEAAEANLHAAAKMNANLTRLVRLQLRYAFDRGDALQVLAKTEKLSKAGALGKSEMERYQNWAYRRQLADAADAAALKTCLKRIPDSLKNGELSVSVAEKYERLGLYADAVKWVKQHYPHNRRPELLEAFVESVRFLGEREQQKAIDFADAWLKEQPDNALLLMYLGRLAYGRKLWGKAKGYLEASIALKPSISARLVLAKVFDEIGEPQKAEAQRNLVLEAVSDDERHAALEQHS

SEQ ID NO: 408 - protein, 405 aa, Neisseria
  VARIANT (1)...(405): Xaa = Any Amino Acid
MKTVVWIVVLFAAAXGLALASGIXTGDVYIVLGQTMLRINLHAFVLGSLIAVVVWYFLFKFIIGVLNXPEKMQRFGSARKGRKAALALNKAGLAYFEGRFEKAELEASRVLGNKEAGDNRTLALMLGAHAAGQMENIELRDRYLAEIAKLPEKQQLSRYLLLAESALNRRDYEAAEANLHAAAKMNANLTRLVRLQLRYAFDRGDALQVLAKTEKXSKAGAXGKSEMERYQNWAYRRQLXDAADAAALKTCLKRIPDSLKNGELSVSVAEKYERLGLYADAVKWVKQHYPHNRRPELLEAFVESVRFLGERDQQKAIDFADAWLKEQPDNALLLXYLGRLAYGRKLWGKAKGYLEASIALKPSISARLVLAKVFDETGEPQKAEAQRNLVLASVAEENRPSAETH

SEQ ID NO: 409 - protein, 405 aa, Neisseria
MKTVVWIVVLFAAAVGLALASGIYTGDVYIVLGQTMLRINLHAFVLGSLIAVVVWYFLFKFIIGVLNIPENMRRSGSARKGRKAALALNKAGLAYFEGRFEKAELEASRVLGNKEAGDNRTLALMLGAHAAGQMENIELRDRYLAEIAKLPEKQQLSRYLLLAESALNRRDYEAAEANLHAAAKMNANLTRLVRLQLRYAFDRGDALQVLAKTEKLSKAGALGKSEMERYQNWAYRRQMADAADAAALKTCLKRIPDSLKNGELSVSVAEKYERLGLYADAVKWVKQHYPHNRRPELLEAFVESVRFLGEREQQKAIDFADSWLKEQPDNALLLMYLGRLAYGRKLWGKAKGYLEASIALKPSIPARLVLAKVFDETAQSQKAEAQRNLVLASVAGENRPSAETR

SEQ ID NO: 410 - protein, 142 aa, Neisseria
  VARIANT (1)...(142): Xaa = Any Amino Acid
MMFSWFKLFHLFFVISWFAGLFYLPRIFVNMAMIDVPRGNPEYVRLSGMAVRLYRFMSPLGFGAVVFGAAIPFAAGWWGSGWVHVKLCLGLMLLAYQLYCGVLLRRFQDYSNAFSHRWYRVFNEIPVLLMVAALYXVVFKPF

SEQ ID NO: 411 - protein, 142 aa, Neisseria
MMFSWFKLFHLFFVISWFAGLFYLPRIFVNMAMIDVPRGNPEYVRLSGMAVRLYRFMSPLGFGAVVFGAAIPFAAGWWGSGWVHVKLCLGLMLLAYQLYCGVLLRRFQDYSNAFSHRWYRVFNEIPVLLMVAALYLVVFKPF

SEQ ID NO: 412 - protein, 142 aa, Neisseria; identical to SEQ ID NO: 411

SEQ ID NO: 413 - protein, 142 aa, Neisseria
MMFSWFKLFHLFFVISWFAGLFYLPRIFVNMAMIDAPRGNPEYVRLSGMAVRLYRFMSPLGFGAVVFGAAIPFAAGRWGSGWVHVKLCLGLMLLAYQLYCGVLLRRFQDYSNAFSHRWYRVFNEIPVLLMVAALYLVVFKPF

SEQ ID NO: 414 - protein, 392 aa, Neisseria
  VARIANT (1)...(392): Xaa = Any Amino Acid
MAKMMKWAAVAAVAAAAVWGGWSXLKPEPHVLDITETVRRGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXISFTILSEPDTPIKAKLDSVDPGLTTMSSGGYNSSTDTASNAVYYYARSFVPNPDGKLATGMTTQNTVEIDGVKNVLIIPSLTVKNRGGKAFVRVLGADGKAAEREIRTGMRDSMNTEVKSGLKEGDKVVISEITAAEQQESGERALGGPPRR

SEQ ID NO: 415 - protein, 334 aa, Neisseria
VSVGAQASGQIKILYVKLGQQVKKGDLIAEINSTSQTNTLNTEKSKLETYQAKLVSAQIALGSAEKKYKRQAALWKENATSKEDLESAQDAFAAAKANVAELKALIRQSKISINTAESELGYTRITATMDGTVVAILVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLIIPSLTVKNRGGKAFVRVLGADGKAAEREIRTGMRDSMNTEVKSGLKEGDKVVISEITAAEQQESGERALGGPPRR

SEQ ID NO: 416 - protein, 392 aa, Neisseria
MAKMMKWAAVAAVAAAAVWGGWSYLKPEPQAAYITETVRRGDISRTVSATGEISPSNLVSVGAQASGQIKKLYVKLGQQVKKGDLIAEINSTSQTNTLNTEKSKLETYQAKLVSAQIALGSAEKKYKRQAALWKDDATAKEDLESAQDALAAAKANVAELKALIRQSKISINTAESELGYTRITATMDGTVVAILVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLIIPSLTVKNRGGRAFVRVLGADGKAAEREIRTGMRDSMNTEVKSGLKEGDKVVISEITAAEQQESGERALGGPPRR

SEQ ID NO: 417 - protein, 392 aa, Neisseria
MAKMMKWAAVAAVAAAAVWGGWSYLKPEPQAAYITEAVRRGDISRTVSATGEISPSNLVSVGAQASGQIKKLYVKLGQQVKKGDLIAEINSTTQTNTIDMEKSKLETYQAKLVSAQIALGSAEKKYKRQAALWKDDATSKEDLESAQDALAAAKANVAELKALIRQSKISINTAESDLGYTRITATMDGTVVAIPVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLLIPSLTVKNRGGKAFVRVLGADGKAVEREIRTGMKDSMNTEVKSGLKEGDKVVISEITAAEQQESGERALGGPPRR

SEQ ID NO: 418 - protein, 184 aa, Neisseria
IPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 419 - protein, 223 aa, Neisseria
MMKTFKNIFSAAILSAALPCAYAAGLPQSAVLHYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 420 - protein, 223 aa, Neisseria
  VARIANT (1)...(223): Xaa = Any Amino Acid
MMKTFKNIFSAAILSAALPCAYAAGLPXSAVLHYSGSYGIPATXXXXXXXNAXKIVSTIKVPLYNIRFESGGTVVGNTLHPTYYRDIRRGKLYAEAKFADGSVTYGKAXXXXXXQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 421 - protein, 223 aa, Neisseria
MMKTFKNIFSAAILSAALPCAYAARLPQSAVLHYSGSYGIPATMTFERSGNAYKIVSTIKVPLYNIRFESGGTVVGNTLHPAYYKDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDTVTYFFAPSLNNIPAQIGYTDDGKTYTLKLKSVQINGQAAKP

SEQ ID NO: 422 - protein, 156 aa, Neisseria
  VARIANT (1)...(156): Xaa = Any Amino Acid
MYRRKGRGIKPWMGAGXAFAALVWLVFALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWLQAHTGELSNALKAWFPVLMRQGGNI

SEQ ID NO: 423 - protein, 356 aa, Neisseria
MYRRKGRGIKPWMGAGAAFAALVWLVFALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWLQAHTGELSNALKAWFPVLMRQGGNIVSSIGNLLLLPLLLYYFLLDWQRWSCGIAKLVPRRFAGAYTRITGNLNEVLGEFLRGQLLVMLIMGLVYGLGLVLVGLDSGFAIGMLAGILVFVPYLGAFTGLLLATVAALLQFGSWNGILSVWAVFAVGQFLESFFITPKIVGDRIGLSPFWVIFSLMAFGQLMGFVGMLAGLPLAAVTLVLLREGVQKYFAGSFYRGR

SEQ ID NO: 424 - protein, 356 aa, Neisseria
MYRRKGRGIKPWMDAGAAFAALVWLVFALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWLQAHTGELSNALKAWFPVLMRQGGNIVSSIGNLLLLPLLLYYFLLDWQRWSCGIAKLVPRRFAGAYTRITGNLNEVLGEFLRGQLLVMLIMGLVYGLGLVLVGLDSGFAIGMVAGILVFVPYLGAFTGLLLATVAALLQFGSWNGILAVWAVFAVGQFLESFFITPKIVGDRIGLSPFWVIFSLMAFGQLMGFVGMLAGLPLAAVTLVLLREGVQKYFAGSFYRGR

SEQ ID NO: 425 - protein, 253 aa, Neisseria
MYRRKGRGIKPWMGAGAAFAALVWLVYALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWFQAHTGELSNALKAWFPVLMKQGGNIVSTIGNLLLPPLLLYYFLLDWHRWSCGIPKLVPRRFAGAYTRITGNLNKVWGKFLRGQLLGETERGAVVCRVGRECWEGGGARSRPSDDGWPRWGGG

SEQ ID NO: 426 - protein, 356 aa, Neisseria
MYRRKGRGIKPWMGAGAAFAALVWLVYALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWFQAHTGELSNALKAWFPVLMKQGGNIVSSIGNLLLPPLLLYYFLLDWQRWSCGIAKLVPRRFAGAYTRITGNLNEVLGEFLRGQLLVMLIMGLVYGLGLMLVGLDSGFAIGMVAGILVFVPYLGAFTGLLLATVAALLQFGSWNGILAVWAVFAVGQFLESFFITPKIVGDRIGLSPFWVIFSLMAFGELMGFVGMLAGLPLAAVTLVLLREGAQKYFAGSFYRGR

SEQ ID NO: 427 - protein, 182 aa, Neisseria
  VARIANT (1)...(182): Xaa = Any Amino Acid
TAFSAALRLSPSXLVIFLSFGKPYQQTAAILTFFCTSCPPRSNAYQQYRRLRLYAFHPPEIAEFFVGFAFDVDARNVYAQIGGDVGTHLRNVRRECGFLCNHGRIDIDRLPTLRLNALIRRTQKDAAVRIFELCGGVGEMAADIAQTCRTEQRVGNGVQQRIGIGVSEQPFFKWDFNSAKYQ

SEQ ID NO: 428 - protein, 256 aa, Neisseria
ISYWASSSPDFLEVDTAPLIFLPLLPKASMKKLMVEPVPMPIYSFSGTNSTAFSAAMRLSSSCVVIFLSFGKPYQQTAAILTFFCTSCPPRSNAYQQYRRLRLYAFHPPEIAEFFVGFAFDVDARNVYAQIGGDVGTHLRNVRREFGFLCNHGRIDIDRLPTLRLNALIRRTQKDAAVRIFELCGGVGEMAADIAQTCRTEQRVGNGVQQRIGIGVSEQPFFKWDFNSAKYQLSAFGQLVDIVALSDTDVRHRLCS

SEQ ID NO: 429 - protein, 256 aa, Neisseria
  VARIANT (1)...(256): Xaa = Any Amino Acid
ISYWASSSLDFLEVDTAPLIFLPLLPKASMKKLMVEPVPMPMYSFSGTNSTAFSAAMRLSSSCVVIFLSFGKPYQQTAAILTFFXTSCPPRSNPYQQYRRLRLYAFHAPEITEFFVGFAFXVDARNVYAQIGGDVGTHLRNMRREFGFLCNHGRIDIDRLPTLRLNALIRRTQKDAAVRIFELCGGVGEMAADIAQTCRTEQRVGNGVQQRIGIGVSEQPFFKWDFNSAKYQLSAFGQLVDIVALSDTDVRHRLCS

SEQ ID NO: 430 - protein, 256 aa, Neisseria
MSYRASSSPDFLEVETAPLIFLPLLPKASMKKLMVEPVPMPMYSFSGTNSTAFSAAMRLSSSCVVIFLSFGKPYQQTAAILTFFCTSWPPRSNPYQQYRRLRLYAFHPPEIAEFFVGFAFDIDARNIDTQIGGDVGTHLRNVRCEFGFLCNHGRIDIDHLPTLRLNALIRRTQKDAAVRIFELCGGVGKMAADVAQTCRTEQRVGNGVQQRVGIRMPEQPFFKWDFNSAKYQLSAFGQLVDIVALSDTDIRHRLCS

SEQ ID NO: 431 - protein, 64 aa, Neisseria
AGASANNISARFAETPVAVSVTLIGTVLAVMLPVTEYENFLLLIGSVFAPMGGFDCRLFRLETA

SEQ ID NO: 432 - protein, 407 aa, Neisseria
MSGNASSPSSSSAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAGLGAAGILAVVLSTVTTTFLDAYSAGASANNISARFAETPVAVGVTLIGTVLAVMLPVTEYENFLLLIGSVFAPMAAVLIADFFVLKRREEIEGFDFAGLVLWLAGFILYRFLLSSGWESSIGLTAPVMSAVAIATVSVRLFFKKTQSLQRNPS

SEQ ID NO: 433 - protein, 347 aa, Neisseria
  VARIANT (1)...(347): Xaa = Any Amino Acid
MSGNASSXSSSAAIGLIWFGAAVSIAEISTGTLLAPLGWQRGLAALLLGHAVGGALFFAAAYIGALTGXXSMESVRLSFGKRGSVLFSVANMLQLAGWTAVMIYAGATVSSALGKVLWDGESFVWWALANGALIVLWLVFGARKTGGLKTVSMLLMLLAVLWLSAEXFSTAGSTAAXVXDGMSFGTAVELSAVMPLSWLPLAADYTRHARRPFAATLTATLAYTLTGCWMYALGLAAALFTGETDVAKILLGAGLGAAGILAVVLSTVTTTFLDAYSAGVSANNISAKLSEIPIAVAVAVVGTLLAVLLPVTEYENFLLLIGSVFAPMAAVLIADFFVLKRREEIEG

SEQ ID NO: 434 - protein, 343 aa, Neisseria
MSGNASSPSSSAAIGLVWFGAAVSIAEISTGTLLAPLGWQRGLAALLLGHAVGGALFFAAAYIGALTGRSSMESVRLSFGKCGSVLFSVANMLQLAGWTAVMIYVGATVSSALGKVLWDGESFVWWALANGALIVLWLVFGARRTGGLKTVSMLLMLLAVLWLSVEVFASSGTNAAPAVSDGMTFGTAVELSAVMPLSWLPLAADYTRQARRPFAATLTATLAYTLTGCWMYALGLAAALFTGETDVAKILLGAGLGITGILAVVLSTVTTTFLDTYSAGASANNISARFAEIPVAVGVTLIRTVLAVMLPVTEYKNFLLLIRSVFGPMAGGFDCRLFCLKTA

SEQ ID NO: 435 - protein, 408 aa, Neisseria
MSGNASSPSSSAAIGLVWFGAAVSIAEISTGTLLAPLGWQRGLAALLLGHAVGGALFFAAAYIGALTGRSSMESVRLSFGKCGSVLFSVANMLQLAGWTAVMIYVGATVSSALGKVLWDGESFVWWALANGALIVLWLVFGARRTGGLKTVSMLLMLLAVLWLSVEVFASSGTNAAPAVSDGMTFGTAVELSAVMPLSWLPLAADYTRQARRPFAATLTATLAYTLTGCWMYALGLAAALFTGETDVAKILLGAGLGITGILAVVLSTVTTTFLDTYSAGASANNISARFAEIPVAVGVTLIGTVLAVMLPVTEYKNFLLLIGSVFAPMAAVLIADFFVLKRREEIEGFDFAGLVLWLAGFILYRFLLSSGWESSIGLTAPVMSAVAIATVSVRLFFKKTQSLQRNPS

SEQ ID NO: 436 - protein, 183 aa, Neisseria
  VARIANT (1)...(183): Xaa = Any Amino Acid
MTRIAILGGGLSGRLTALQLAEQGYQIALFDKSCRRGEHAAAYVAAAMLAPAAXTVEATPEVVRLGRQSIPLWRGIRCRLNTHTMMQENGSLIVWHGQDKPLSSEFVRHLKRGGXTDDEIVRWRADDIAEREPQLGGRFXDGIYLPTEXQLDGRQLXSALADALDELNVPCHWEHECVPEACK

SEQ ID NO: 437 - protein, 366 aa, Neisseria
MTRIAILGGGLSGRLTALQLAEQGYQIALFDKGCRRGEHAAAYVAAAMLAPAAEAVEATPEVVRLGRQSIPLWRGIRCRLNTHTMMQENGSLIVWHGQDKPLSSEFVRHLKRGGVADDEIVRWRADDIAEREPQLGGRFSDGIYLPTEGQLDGRQILSALADALDELNVPCHWEHECVPEGLQAQYDWLIDCRGYGAKTAWNQSPEHTSTLRGIRGEVARVYTPEITLNRPVRLLHPRYPLYIAPKENHVFVIGATQIESESQAPASVRSGLELLSALYAIHPAFGEADILEIATGLRPTLNHHNPEIRYNRARRLIEINGLFRHGFMISPAVTAAAARLAVALFDGKDAPERDKESGLAYIRRQD

SEQ ID NO: 438 - protein, 366 aa, Neisseria
  VARIANT (1)...(366): Xaa = Any Amino Acid
MTRIAILGGGLSGRLTALQLAEQGYQIALFDKGCRRGEHAAAYVAAAMLAPAAEAVEATPEVVRLGRQXIPLWRGIRCHLKTPAMMXENGSLIVWHGQDKPLSNEFVRHLKRGGVADDXIVRWRADDIAEREPQLGGRFSDGIYLPTEGQLDGRQILSALADALDELNVPCHWEHECAPEDLQAQYDWLIDCRGYGAKTAWNQSPXXTSTLRGIRGEVARVYTPEITLNRPVRLLHPRYPLYIAPKENXVFVIGATQIESESQAPASVRSGLELLSALYAVHPAFGEADILEIATGLRPTLNHHNPEIRYNRARRLIEINGLFRHGFMISPAVTAAAVRLAVALFDGKXAPERDEESGLAYIRRQD

SEQ ID NO: 439 - protein, 366 aa, Neisseria
MTRIAVLGGGLSGRLTALQLAEQGYQIELFDKGTRQGEHAAAYVAAAMLAPAAEAVEATPEVIRLGRQSIPLWRGIRCRLNTLTMMQENGSLIVWHGQDKPLSSEFVRHLKRGGVADDEIVRWRADEIAEREPQLGGRFSDGIYLPTEGQLDGRQILSALADALDELNVPCHWEHECAPQDLQAQYDWVIDCRGYGAKTAWNQSPEHTSTLRGIRGEVRGFTRPKSRSTAPCACCTRAIRSTSPRKKTTSSSSARPKSKAKAKPPPAYVPGWNSYPRSMPSTPPSAKPTSSKWRPGLRPTLNHHNPEIRYSRERRLIEINGLFRHGFMISPAVTAAAVRLAVALFDGKDAPERDEESGLAYIGRQD

SEQ ID NO: 440 - protein, 366 aa, Neisseria
MTRIAVLGGGLSGRLTALQLAEQGYQIELFDKGTRQGEHAAAYVAAAMLAPAAEAVEATPEVIRLGRQSIPLWRGIRCRLNTLTMMQENGSLIVWHGQDKPLSSEFVRHLKRGGVADDEIVRWRADEIAEREPQLGGRFSDGIYLPTEGQLDGRQILSALADALDELNVPCHWEHECAPQDLQAQYDWVIDCRGYGAKTAWNQSPEHTSTLRGIRGEVARVYTPEITLNRPVRLLHPRYPLYIAPKENHVFVIGATQIESESQAPASVRSGLELLSALYAVHPAFGEADILEIAAGLRPTLNHHNPEIRYSRERRLIEINGLFRHGFMISPAVTAAAVRLAVALFDGKDAPERDEESGLAYIGRQD

SEQ ID NO: 441 - protein, 150 aa, Neisseria
  VARIANT (1)...(150): Xaa = Any Amino Acid
MTDNRGFTLVELISVVLILSVLALIVYPSYRNYVEKAKINAVRAALLENAHFMEKFYLQNGRFKQTSTKWPSLPIKEAEGFCIRLNGIVARXALDSKFMLKAVAIDKDKNPFIIKMNENLVTFICKKSASSCSDGLDYFKGNDKDCKLLK

SEQ ID NO: 442 - protein, 149 aa, Neisseria
MTDNRGFTLVELISVVLILSVLALIVYPSYRNYVEKAKINAVRAALLENAHFMEKFYLQNGRFKQTSTKWPSLPIKEAEGFCIRLNGIARGALDSKFMLKAVAIDKDKNPFIIKMNENLVTFICKKSASSCSDGLDYFKGNDKDCKLLK

SEQ ID NO: 443 - protein, 149 aa, Neisseria
MTDNRGFTLVELISVVLILSVLALIVYPSYRNYVEKAKINTVRAALLENAHFMEKFYLQNGRFKQTSTKWPSLPIKEAEGFCIRLNGIARGALDSKFMLKAVAIDKDKNPFIIKMNENLVTFICKKSASSCSDGLDYFKGNDKDCKLLK

SEQ ID NO: 444 - protein, 149 aa, Neisseria
MTDNRGFTLVELISVVLILSVLALIVYPSYRNYVEKAKINAVRAAFLENAHFMEKFYLQNGRFKQTSTKWPSLPIKEAEGFCIRLNGIARGALDSKFMLKAVAIDKDKNPFIIKMNENLVTFICKKSASSCSDRLDYFKGNDKDCKLLK

SEQ ID NO: 445 - protein, 244 aa, Neisseria
VSLASVIASQIFLYEDFNQMRKTVELSAVFLSNIYLGFQQGYFDLSADENPVLHIWSLAVEEQYYLLYPLLLIFCCKKTKSLRVLRNISIILFLILTASSFLPSGFYTDILNQPNTYYLSTLRFPELLAGSLLAVYGQTQNGRRQTANGKRQLLSSLCFGALLACLFVIDKHNPFIPGMTLLLPCLLTALLIRSMQYGTLPTRILSASPIVFVGKISYSLYLYHWIFIAFAPLIRGGKQLGLPA

SEQ ID NO: 446 - protein, 622 aa, Neisseria
MQAVRYRPEIDGLRAVAVLSVMIFHLNNRWLPGGFLGVDIFFVISGFLITGIILSEIQNGSFSFRDFYTRRIKRIYPAFIAAVSLASVIASQIFLYEDFNQMRKTVELSAVFLSNIYLGFQQGYFDLSADENPVLHIWSLAVEEQYYLLYPLLLIFCCKKTKSLRVLRNISIILFLILTASSFLPSGFYTDILNQPNTYYLSTLRFPELLAGSLLAVYGQTQNGRRQTANGKRQLLSSLCFGALLACLFVIDKHNPFIPGMTLLLPCLLTALLIRSMQYGTLPTRILSASPIVFVGKISYSLYLYHWIFIAFAHYITGDKQLGLPAVSAVAALTAGFSLLSYYLIEQPLRKRKMTFKKAFFCLYLAPSLILVGYNLYARGILKQEHLRPLPGAPLAAENHFPETVLTLGDSHAGHLRGFLDYVGSREGWKAKILSLDSECLVWVDEKLADNPLCRKYRDEVEKAEAVFIAQFYDLRMGGQPVPRFEAQSFLIPGFPARFRETVKRIAAVKPVYVFANNTSISRSPLREEKLKRFAANQYLRPIQAMGDIGKSNQAVFDLIKDIPNVHWVDAQKYLPKNTVEIYGRYLYGDQDHLTYFGSYYMGREFHKHERLLKSSHGGALQ

SEQ ID NO: 447 - protein, 622 aa, Neisseria
MQAVRYRPEIDGLRAVAVLSVMIFHLNNRWLPGGFLGVDIFFVISGFLITGIILSEIQNGSFSFRDFYTRRIKRIYPAFIAAVSLASVIASQIFLYEDFNQMRKTVELSAVFLSNIYLGFQQGYFDLSADENPVLHIWSLAVEEQYYLLYPLLLIFCCKKTKSLRVLRNISIILFLILTATSFLPSGFYTDILNQPNTYYLSTLRFPELLAGSLLAVYGQTQNGRRQTANGKRQLLSSLCFGALLACLFVIDKHNPFIPGMTLLLPCLLTALLIRSMQYGTLPTRILSASPIVFVGKISYSLYLYHWIFIAFAHYITGDKQLGLPAVSAVAALTAGFSLLSYYLIEQPLRKRKMTFKKAFFCLYLAPSLILVGYNLYARGILKQEHLRPLPGAPLAAENHFPETVLTLGDSHAGHLRGFLDYVGSREGWKAKILSLDSECLVWVDEKLADNPLCRKYRDEVEKAEAVFIAQFYDLRMGGQPVPRFEAQSFLIPGFPARFRETVKRIAAVKPVYVFANNTSISRSPLREEKLKRFAANQYLRPIQAMGDIGKSNQAVFDLIKDIPNVHWVDAQKYLPKNTVEIYGRYLYGDQDHLTYFGSYYMGREFHKHERLLKSSRDGALQ

SEQ ID NO: 448 - protein, 622 aa, Neisseria
MQAVRYRPEIDGLRAVAVLSVIIFHLNNRWLPGGFLGVDIFFVISGFLITNIILSEIQNGSFSFRDFYTRRIKRIYPAFIAAVSLASVIASQIFLYEDFNQMRKTIELSTVFLSNIYLGFRLGYFDLSADENPVLHIWSLAVEEQYYLLYPLLLIFCYKKTKSLRVLRNISIILFLILTASSFLPAGFYTDILNQPNTYYLSTLRFPELLVGSLLAVYGQTQNGRRQTENGKRQLLSLLCFGALLVCLFVIDKHDPFIPGITLLLPCLLTALLIRSMQYGTLPTRILSASPIVFVGKISYSLYLYHWIFIAFAHYITGDKQLGLPAVSAVAALTAGFSLLSYYLIEQPLRKRKMTFKKAFFCLYLAPSLMLVGYNLYSRGILKQEHLRPLPGTPVAAENNFPETVLTLGDSHAGHLRGFLDYVGGREGWKAKILSLDSECLVWVDEKLADNPLCRKYRDEVEKAEAVFIAQFYDLRMGGQPVPRFEAQSFLIPGFKARFRETVKRIAAVKPVYVFANNTSISRSPLREEKLKRFAINQYLRPIRAMGDIGKSNQAVFDLVKDIPNVHWVDAQKYLPKNTVEIHGRYLYGDQDHLTYFGSYYMGREFHKHERLLKHSRGGALQ

SEQ ID NO: 449 - protein, 88 aa, Neisseria
  VARIANT (1)...(88): Xaa = Any Amino Acid
IIYEYRWMFLYGALTTLGLTVVAXAGGSVLGLLLALARLIHLEKAGAPMRVLAWALRKVSLLYVTLFRGTPLFVQIVIWAYVWFPFFV

SEQ ID NO: 450 - protein, 248 aa, Neisseria
MDFRFDIIYEYRWMFLYGALTTLGLTVVATAGGSVLGLLLALARLIHLEKAGAPMRVLAWALRKVSLLYVTLFRGTPLFVQIVIWAYVWFPFFVHPSDGILVSGEAAIALRRGYGPLIAGSLALIANSGAYICEIFRAGIQSIDKGQMEAARSLGLTYPQAMRYVILPQALRRMLPPLASEFITLLKDSSLLSVIAVAELAYVQNTITGRYSVYEEPLYTVALIYLLMTTFLGWIFLRLEKRYNPQHR

SEQ ID NO: 451 - protein, 248 aa, Neisseria; identical to SEQ ID NO: 450

SEQ ID NO: 452 - protein, 174 aa, Neisseria
MDFRFDIIYEYRWMFLYGALTTLGLTVVATAGGSVLGLLLALARLIHLEKAGAPMRVLAWALRKVSLLYVTLFRGTPLFVQIVIWAYVWFPFFVILHTAFLGNAMRQSRRVPDKGRWIAGSLELNCQPRGRKTRGEFPPGESNLGTEPRNPLSMGQRRFPGCENWYPPQNFIKK

SEQ ID NO: 453 - protein, 248 aa, Neisseria; identical to SEQ ID NO: 450

SEQ ID NO: 454 - protein, 193 aa, Neisseria
  VARIANT (1)...(193): Xaa = Any Amino Acid
LKECRLKDPVFIPNIVYKNIAITFLLLHAAAELWLPAQTAGFTALAVGFILLAKLRELHHHELLRKHYVRTYYLLQLFAAAGSLWTGAAXLQNLPASAPLHLITLGGMMGGVMMVWLTAGLWHSGFTKLDYPKLCRIAVPILFAAAVSRAFLXNVNPXFFITVPAILTAAVFVLYLFXFIPIFRANAFTDDPE

SEQ ID NO: 455 - protein, 357 aa, Neisseria
MRPFFVGAAVLAILGALVFFINPGAIVLHRQIFLELMLPAAYGGFLTAALLDWTGFSGNLKPVATLMAALLLAASAILPFSPQTASFFVAAYWLVLLLFCARLIWLDRNTDNFALLMLLAAFTVFQTAYAVSGDLNLLRAQVHLNMAAVMFVSVRVSILLGAEALKECRLKDPVFIPNIVYKNIAITFLLLHAAAELWLPAQTAGFTALAVGFILLAKLRELHHHELLRKHYVRTYYLLQLFAAAGYLWTGAAKLQNLPASAPLHLITLGGMMGGVMMVWLTAGLWHSGFTKLDYPKLCRIAVPILFAAAVSRAFLMNVNPIFFITVPAILTAAVFVLYLFTFIPIFRANAFTDDPE

SEQ ID NO: 456 - protein, 357 aa, Neisseria
MRPFFVGAAVLAILGALVFFINPGAIVLHRQIFLELMLPAAYGGFLTAALLDWTGFSGNLKPVATLMAALLLAASAILPFSPQTASFFVAAYWLVLLLFCARLIWLDRNTDNFALLMLLAAFTVFQTAYAVSGDLNLLRAQVHLNMAAVMFVSVRVSILLGAEALKECRLKDPVFIPNVVYKNIAITFLLLHAAAELWLPAQTAGFTSLAVGFILLAKLRELHHHELLRKHYVRTYYLLQLFAAAGYLWTGAAKLQNLPASAPLHLITLGGMMGSVMMVWLTAGLWHSGFTKLDYPKLCRIAVPILFAAAVSRAVLMNVNPIFFITVPAILTAAVFVLYLLTFVPIFRANAFTDDPE

SEQ ID NO: 457 - protein, 364 aa, Neisseria
MNKFFTHPMRPFFVGAAVLAILGALVFFHQPRRYHPAPPNFLGTYAAGCIRRFFDYRFVGPDGFFRQPETCRYFDGGVVACCGCFIAVFTATCRIFRRRLLAGVAAVLRLADLARRQHRTLRSVDVTAAFTVFQTAYAVSGDLNLLRAQVHLNMAAVMFVSVRVSVLLGTETLKECRLKDPVFIPNVIYKNIAITLLLHAAAELWLPAQTAGFTALAVGFILLAKLRELHHHELLRKHYVRTYYLLQLFAAAGYLWTGAAKLQNLPASAPLHLITLGGMTGGVMMVWLTAGLWHSGFTKLDYPKLCRIAVSILFASAVSRAVLMNVNPIFFITVPEILTAAVFMLYLLTFVPIFRANAFTDDPE

SEQ ID NO: 458 - protein, 356 aa, Neisseria
MRPFFVGAAVLAILGALVFFINPGAIILHRQIFLELMLPAAYGGFLTTALLDRTGFSGNLKPAATLMAVLLLVAAVLLPFLPQLAAFFVAAYWLVLLLFCAWLIWLDRNTDNFALLMLLAAFTVFQTAYAVSGDLNLLRAQVHLNMAAVMFVSVRVSVLLGTETLKECRLKDPVFIPNVIYKNIAITLLLHAAAELWLPAQTAGFTALAVGFILLAKLRELHHHELLRKHYVRTYYLLQLFAAAGYLWTGAAKLQNLPASAPLHLITLGGMTGGVMMVWLTAGLWHSGFTKLDYPKLCRIAVSILFASAVSRAVLMNVNPIFFITVPEILTAAVFMLYLLTFVPIFRANAFTDDPE

SEQ ID NO: 459 - protein, 121 aa, Neisseria
  VARIANT (1)...(121): Xaa = Any Amino Acid
MEIRAIKYTAMAALLAFTVAGCRLAGWYECSSLTGWCKPRKPAAIDFWDIGGESPPSLGDYEIPLSDGNSSVRANEYESAQQSYFYRKIGKFEXCGLDWRTRDGKPLIETFKQGGFDCLEK

SEQ ID NO: 460 - protein, 135 aa, Neisseria
MEIRAIKYTAMAALLAFTVAGCRLAGWYECSSLTGWCKPRKPAAIDFWDIGGESPPSLGDYEIPLSDGNRSVRANEYESAQQSYFYRKIGKFEACGLDWRTRDGKPLIETFKQGGFDCLEKQGLRRNGLSERVRW

SEQ ID NO: 461 - protein, 135 aa, Neisseria
MEIRAIKYTAMAALLAFTVAGCRLAGWYECSSLSGWCKPRKPAAIDFWDIGGESPPSLEDYEIPLSDGNRSVRANEYESAQQSYFYRKIGKFEACGLDWRTRDGKPLIETFKQEGFDCLKKQGLRRNGLSERVRW

SEQ ID NO: 462 - protein, 135 aa, Neisseria
MEIRVIKYTATAALFAFTVAGCRLAGWYECLSLSGWCKPRKPAAIDFWDIGGESPLSLEDYEIPLSDGNRSVRANEYESAQKSYFYRKIGKFEACGLDWRTRDGKPLVERFKQEGFDCLEKQGLRRNGLSERVRW

SEQ ID NO: 463 - protein, 135 aa, Neisseria
MEIRVIKYTATAALFAFTVAGCRLAGWYECSSLSGWCKPRKPAAIDFWDIGGESPLSLEDYEIPLSDGNRSVRANEYESAQKSYFYRKIGKFEACGLDWRTRDGKPLVERFKQEGFDCLEKQGLRRNGLSERVRW

SEQ ID NO: 464 - protein, 259 aa, Neisseria
  VARIANT (1)...(259): Xaa = Any Amino Acid
MKHIHIIGIGGTFMGGLAAIAKEAGFEVSGCDAKMYPPMSTQLEALGIDVYEGFDAAQLDEFKADVYVIGNVAKRGMDVVEAILNLGLPYISGPQWLSENVLHHHWVLGVAGTHGKTTTASMLAWVLEYAGLAPGFLIGGVXGKFRRFRPPAANAAPRPEQPIAVFRHRSRRIRHRLFRQTFXIRALPSAYRRVEQSGIRPRRHLCRLGRDTDPVPLPRAYRAVXRLNRLQRTAAKPARYFGQRLLDAGGKIRHGTRLA

SEQ ID NO: 465 - protein, 458 aa, Neisseria
MKHIHIIGIGGTFMGGLAAIAKEAGFEVSGCDAKMYPPMSTQLEALGIDVYEGFDAAQLDEFKADVYVIGNVAKRGMDVVEAILNLGLPYISGPQWLSENVLHHHWVLGVAGTHGKTTTASMLAWVLEYAGLAPGFLIGGVPENFGVSARLPQTPRQDPNSQSPFFVIEADEYDTAFFDKRSKFVHYRPRTAVLNNLEFDHADIFADLGAIQTQFHYLVRTVPSEGLIVCNGRQQSLQDTLDKGCWTPVEKFGTEHGWQAGEANADGSFDVLLDGKTAGRVKWDLMGRHNRMNALAVIAAARHVGVDIQTACEALGAFKNVKRRMEIKGTANGITVYDDFAHHPTAIETTIQGLRQRVGGARILAVLEPRSNTMKLGTMKSALPVSLKEADQVFCYAGGVDWDVAEALAPLGGRLNVGKDFDAFVAEIVKNAEVGDHILVMSNGGFGGIHGKLLEALR

SEQ ID NO: 466 - protein, 458 aa, Neisseria
  VARIANT (1)...(458): Xaa = Any Amino Acid
MKHIHIIGIGGTFMGGIAAIAKEAGFEXSGCDAKMYPPMSTQLEALGIGVYEGFDTAQLDEFKADVYVIGNVAKRGMDVVEAILNRGLPYISGPQWLAENXLHHHWXLGVAXTHGKTTTASMLAWVLEYAGLAPGFXIGGVPENFSVSARLPQTPRQDPNSQSPFFVIEADEYDTAFFDKRSKFVHYRPRTAVLNNLEFDHADIFADLGAIQTQFHHLVRTVPSEGLIVCNGRQQSLQDTLDKGCWTPVEKFGTEHGWQAGEANADGSFDVLLDGKKAGHVAWSLMGGHNRMNALAVIAAARHAGVDIQTACEALSTFKNVKRRMEIKGTANGITVYDDFAHHPTAIETTIQGLRQRVGGARILAVLEPRSNTMKLGTMKAALPASLKEADQVFXYAGGADWDVAEALAPLGGRLHVGKDFDAFVAEIVKNAEAGDHILVMSNGGFGGIHTKLLDALR

SEQ ID NO: 467 - protein, 261 aa, Neisseria
MKHIHIIGIGGTFMGGIAAIAKEAGFKVSGCDAKMYPPMSTQLEALGIGVHEGFDAAQLEEFQADIYVIGNVARRGMDVVEAILNRGLPYISGPQWLAENVLHHHWVLGVAGTHGKTTTASMLAWVLEYAGLAPGFLIGGVPGKFRRFRPPTANAASRPEQQIAVFRHRSRRIRHRLFRQTLQIRALSPAYRRVEQSGIRPRRHLRRLGRDTDPVPPPRAHRTIRRPHRLQRTAAKPARYFGQRLLDAGGKIRHRTRLADW

SEQ ID NO: 468 - protein, 458 aa, Neisseria
MKHIHIIGIGGTFMGGIAAIAKEAGFKVSGCDAKMYPPMSTQLEALGIGVHEGFDAAQLEEFQADIYVIGNVARRGMDVVEAILNRGLPYISGPQWLAENVLHHHWVLGVAGTHGKTTTASMLAWVLEYAGLAPGFLIGGVPENFGVSARLPQTPRQDPNSKSPFFVIEADEYDTAFFDKRSKFVHYRPRTAVLNNLEFDHADIFADLGAIQTQFHHLVRTVPSEGLIVCNGQQQSLQDTLDKGCWTPVEKFGTGHGWQIGEVNADGSFDVLLDGKKAGHVAWDLMGGHNRMNALAVIAAARHAGVDVQTACEALGAFKNVKRRMEIKGTANGITVYDDFAHHPTAIETTIQGLRQRVGGARILAVLEPRSNTMKLGTMKSALPASLKEADQVFCYAGGADWDVAEALAPLGCRLRVGKDFDTFVAEIVKNARTGDHILVMSNGGFGGIHTKLLDALR

SEQ ID NO: 469 - protein, 393 aa, Neisseria
  VARIANT (1)...(393): Xaa = Any Amino Acid
PGYYGSDDEFKRAFGENSPTXKKHCNRSCGIYEPVLKKYGKKRANNHSVSISADFGDYFMPFASYSRTHRMPNIQEMYFSQIGDSGVHTALKPERANTWQFGFXTYKKGLLKQDDTLGLKLVGYRSRIDNYIHNVYGKWWDLNGDIPSWVSSTGLAYTIQHRXFXDKVHQXXXXXXXXYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNFRQLGKRSIKQTETLARQPLIXDFNAAYEPKKNLIFRAEVKNLFDRRYIDPLDAGNDAAXERYYSSFDPKDKDXDVTCNADKTLCNGKYGGTSKSVLTNFARGRTFLMTMSYKF

SEQ ID NO: 470 - protein, 888 aa, Neisseria
  VARIANT (1)...(888): Xaa = Any Amino Acid
EAQIQVLEDVHVKAKRVPKDKKVFTDARAVSTRQDIFKSSENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRSVAQNYRVGGGGQHIGNFGAEYLERRKQRYFVQEGALKFNSDSGKWERDLQRQQWKYKPYKNYNNQELQKYIEEHDKSWRENLXPQYDITPIDPSSLKQQSAGNLFKLEYDGVFNKYTAQFRDLNTKIGSRKIINRNYQFNYGLSLNPYTNLNLTAAYNSGRQKYPKGSKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNTVGYRFGGEYTGYYGSDDEFKRAFGENSPTYKKHCNRSCGIYEPVLKKYGKKRANNHSVSISADFGDYFMPFASYSRTHRMPNIQEMYFSQIGDSGVHTALKPERANTWQFGFNTYKKGLLKQDDTLGLKLVGYRSRIDNYIHNVYGKWWDLNGDIPSWVSSTGLAYTIQHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNFRQLGKRSIKQTETLARQPLIFDFYAAYEPKKNLIFRAEVKNLFDRRYIDPLDAGNDAATQRYYSSFDPKDKDEDVTCNADKTLCNGKYGGTSKSVLTNFARGRTFLMTMSYKF

SEQ ID NO: 471 - protein, 871 aa, Neisseria
  VARIANT (1)...(871): Xaa = Any Amino Acid
KDKKVFTDARAVSTRQDIFKSXENLDNIVRXIPGAFTXQXKSSGXVSLNIRXDSGFGRVNTMVDGITXTFYSTSTDAGRAGGSSQFGASVDSNFXAGLDVVKGSFSGSAGINSLAGSANLRTLXVDDVVQGNXTYGLLLKGLTGTNSTKGNAMAAIGARKWLESGASVGVLYGHSRRSVAQNYRVGGGGQHIGNFGAEYLERRKQRYFEQEGGLKFNSNSGKWERDFQKSYWKTKWYQKYDAPQELQKYIEGHDKSWRENLAPQYDITPIDPSSLKXQSAGNLFKLEYDGVFNKYTAQFRDLNTKIGSRKIINRNYQFNYGLSLNPYTNLNLTAAYNSGRQKYPKGSKFTGWGLXKDFETYNNAKILDLXNTSTFRLPRETELQTTLGFNYFHNEYGKNRFPEELGLFFDGPDXDNGLYSYLGRFKGDKGLLPQKSTIVQPAGSQYFNTFYFDAALKKDIYRLNYSTNTVGYRFGGXYTGYYXSDDEFKRAFGENSPTYXKHCNQSCGIYEPVLKKYGKKRANNHSVSISADFGDYFMPFASYSRTHRMPNIQEMYFSQIGDSGVHTALKPERANTWQFGFNTYKKGLLKQDDILGLKLVGYRSRIDXYIHNVYGKWWDLNGNIPSWVSSTGLAYTIQHRNFKDKVHKHGFELELNYDYXRFFTNLSYAYQKSTQPTNFSDASESPNNASKEDQLKQGYGLSRVSALPRDYGRLEVGTRWLGNKLTLGGAMRYFGKSIRATAEERYIDXTNGXXTSNFRQLGKRSIXQTETLARQPLIFDXYAAYEPKKXLIFRAEVKNLFDRRYIDPLDAGNDAATQRYYSSFDPKDKDEEVTCNDDNTLCNGKYGGTSKSVLTNFARGXTFLITMSYKF

SEQ ID NO: 472 - protein, 922 aa, Neisseria
MRSSFRLKPICFYLMGVMLYHHSYAEDAGRAGSEAQIQVLEDVHVKAKRVPKDKKVFTDARAVSTRQDVFKSGENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRGVAQNYRVGGGGQHIGNFGEEYLERRKQQYFVQEGGLKFNAGSGKWERDLQRQYWKTKWYKKYEDPQELQKYIEEHDKSWRENLAPQYDITPIDPSGLKQQSAGNLLNLEYDGVFNKYTAQFRDLNTRIGSRKIINRNYQFNYGLSLNPYTNLNLTAAYNSGRQKYPKGAKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNAINYRFGGEYTGYYGSENEFKRAFGENSPAYKEHCDPSCGLYEPVLKKYGKKRANNHSVSISADFGDYFMPFAGYSRTHRMPNIQEMYFSQIGDSGVHTALKPERANTWQFGFNTYKKGLLKQDDILGLKLVGYRSRIDNYIHNVYGKWWDLNGDIPSWVGSTGLAYTIRHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNVRQLGKRSIKQTETLARQPLIFDFYAAYEPKKNLIFRAEVKNLFDRRYIDPLDAGNDAATQRYYSSFDPKDKDEDVTCNADKTLCNGKYGGTSKSVLTNFARGRTFLMTMSYKF

SEQ ID NO: 473 - protein, 922 aa, Neisseria
MRSSFRLKPICFYLMGVMLYHHSYAEDAGRAGSEAQIQVLEDVHVKAKRVPKDKKVFTDARAVSTRQDVFKSGENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRGVAQNYRVGGGGQHIGNFGEEYLERRKQQYFVQEGGLKFNAGSGKWERDLQRQYWKTKWYKKYEDPQELQKYIEEHDKSWRENLAPQYDITPIDPSGLKQQSAGNLFKLEYDGVFNKYTAQFRDLNTRIGSRKIINRNYQFNYGLSLNPYTNLNLTAAYNSGRQKYPKGAKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNAINYRFGGEYTGYYGSENEFKRAFGENSPAYKEHCDPSCGLYEPVLKKYGKKRANNHSVSISADFGDYFMPFAGYSRTHRMPNIQEMYFSQIGDSGVHTALKPERANTWQFGFNTYKKGLLKQDDILGLKLVGYRSRIDNYIHNVYGKWWDLNGDIPSWVGSTGLAYTIRHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNVRQLGKRSIKQTETLARQPLIFDFYAAYEPKKNLIFRAEVKNLFDRRYIDPLDAGNDAATQRYYSSFDPKDKDEDVTCNADKTLCNGKYGGTSKSVLTNFARGRTFLMTMSYKF

SEQ ID NO: 474 - protein, 166 aa, Neisseria
MNLISRYIIRQMAVMAVYALLAFLALYSFFEILYETGNLGKGSYGIWEMLGYTALKMPARAYELIPLAVLIGGLVSLSQLAAGSELTVIKASGMSTKKLLLILSQFGFIFAIATVALGEWVAPTLSQKAENIKAAAINGKISTGNTGLWLKEKNSVINVREMLPDH

SEQ ID NO: 475 - protein, 326 aa, Neisseria
  VARIANT (1)...(326): Xaa = Any Amino Acid
MNLISRYIIRQMAVMAVYALLAFLALYSFFEILYETGNLGKGSYGIWEMLGYTALKMPARAYELIPLAVLIGGLVSLSQLAAGSELTVIKASGMSTKKLLLILSQFGFIFAIATVALGEWVAPTLSQKAENIKAAAINGKISTGNTGLWLKEKNSXINVREMLPDHTLLGIKIWARNDKNELAEAVEADSAVLNSDGSWQLKNIRRSTLGEDKVEVSIAAEENWPISVKRNLMDVLLVKPDQMSVGELTTYIRHLQNNSQNTRIYAIAWWRKLVYPAAAWVMALVAFAFTPQTTRHGNMGLKLFGGICXGLLFHLAGRLFGFTSQL

SEQ ID NO: 476 - protein, 356 aa, Neisseria
  VARIANT (1)...(356): Xaa = Any Amino Acid
MNLISRYIIRQMAVMAVYALLAFLALYSFFEILYETGNLGKGSYGIWEMXGYTALKMXARAYELMPLAVLIGGLVSXSQLAAGSELXVIKASGMSTKKLLLILSQFGFIFAIATVALGEWVAPTLSQKAENIKAAAINGKISTGNTGLWLKEKNSIINVREMLPDHTLLGIKIWARNDKNELAEAVEADSAVLNSDGSWQLKNIRRSTLGEDKVEVSIAAEEXWPISVKRNLMDVLLVKPDQMSVGELTTYIRHLQXXSQNTRIYAIAWWRKLVYPAAAWVMALVAFAFTPQTTRHGNMGLKXFGGICLGLLFHLAGRLFXFTSQLYGIPPFLXGALPTIAFALLAVWLIRKQEKR

SEQ ID NO: 477 - protein, 356 aa, Neisseria
MNLISRYIIRQMAVMAVYALLAFLALYSFFEILYETGNLGKGSYGIWEMLGYTALKMPARAYELMPLAVLIGGLASLSQLAAGSELAVIKASGMSTKKLLLILSQFGFIFAIAAVALGEWVAPTLSQKAENIKAAAINGKISTGNTGLWLKEKTSIINVRGMLPDHTLLGIKIWARNDKNELAEAVEADSAVLNSDGSWQLKNIRRSIMGTDKIETSAAAEETWPIAVRRNLMDVLLVKPDQMSVGELTTYIRHLQNNSQNTQIYAIAWWRKLVYPVAAWVMALVAFAFTPQTTRHGNMGLKLFGGICLGLLFHLAGRLFGFTSQLYGTPPFLAGALPTIAFALLAVWLIRKQEKR

SEQ ID NO: 478 - protein, 245 aa, Neisseria
  VARIANT (1)...(245): Xaa = Any Amino Acid
TLLFATVQASANQEEQEEDLYLDPVQRTVAVLIVNSDKEGTGEKEKVEENSDWAVYFNEKGVLTAREITXKAGDNLKIKQNGTNFTYSLKKDLTDLTSVGTEKLSFSANGNKVNITSDTKGLNFAKETAGTNGDTTVHLNGIGSTLTDTLLNTGATTNVTNDNVTDDEKKRAASVKDVLNAGWNIKGVKPGTTASDNVDFVRTYDTVEFLSADTKTTTVNVESKDNGKKTEVKIGAKTSVIKEKD

SEQ ID NO: 479 - protein, 591 aa, Neisseria
MNKIYRIIWNSALNAWVVVSELTRNHTKRASATVKTAVLATLLFATVQASANNEEQEEDLYLDPVQRTVAVLIVNSDKEGTGEKEKVEENSDWAVYFNEKGVLTAREITLKAGDNLKIKQNGTNFTYSLKKDLTDLTSVGTEKLSFSANGNKVNITSDTKGLNFAKETAGTNGDTTVHLNGIGSTLTDTLLNTGATTNVTNDNVTDDEKKRAASVKDVLNAGWNIKGVKPGTTASDNVDFVRTYDTVEFLSADTKTTTVNVESKDNGKKTEVKIGAKTSVIKEKDGKLVTGKDKGENGSSTDEGEGLVTAKEVIDAVNKAGWRMKTTTANGQTGQADKFETVTSGTNVTFASGKGTTATVSKDDQGNITVMYDVNVGDALNVNQLQNSGWNLDSKAVAGSSGKVISGNVSPSKGKMDETVNINAGNNIEITRNGKNIDIATSMTPQFSSVSLGAGADAPTLSVDGDALNVGSKKDNKPVRITNVAPGVKEGDVTNVAQLKGVAQNLNNRIDNVDGNARAGIAQAIATAGLVQAYLPGKSMMAIGGGTYRGEAGYAIGYSSISDGGNWIIKGTASGNSRGHFGASASVGYQW

SEQ ID NO: 480 - protein, 592 aa, Neisseria
  VARIANT (1)...(592): Xaa = Any Amino Acid
MNKIYRIIWNSALNAXVAVSELTRNHTKRASATVKTAVLATLLFATVQANATDEDEEEELESVQRSVVGSIQASMEGSGELETISLSMTNDSKEFVDPYIVVTLKAGDNLKIKQNTNENTNASSFTYSLKKDLTGLINVXTEKLSFGANGKKVNIISDTKGLNFAKETAGTNGDTTVHLNGIGSTLTDTLAGSSASHVDAGNXSTHYTRAASIKDVLNAGWNIKGVKXGSTTGQSENVDFVRTYDTVEFLSADTXTTTVNVESKDNGKRTEVKIGAKTSVIKEKDGKLVTGKGKGENGSSTDEGEGLVTAKEVIDAVNKAGWRMKTTTANGQTGQADKFETVTSGTNVTFASGKGTTATVSKDDQGNITVMYDVNVGDALNVNQLQNSGWNLDSKAVAGSSGKVISGNVSPSKGKMDETVNINAGNNIEISRNGKNIDIATSMAPQFSSVSLGAGADAPTLSVDDEGALNVGSKDANKPVRITNVAPGVKXGDVTNVXQLKGVAQNLNNRIDNVDGNARAGIAQAIATAGLVQAYLPGKSMMAIGGGTYRGEAGYAIGYSSISDGGNWIIKGTASGNSRGHFGASASVGYQW

SEQ ID NO: 481 - protein, 164 aa, Neisseria
  VARIANT (1)...(164): Xaa = Any Amino Acid
MLRLTALAVCTALALGACSPQNSDSAPQAKEQAVSAAQTEGASVTVKTARGDVQIPQNPERIAVYDLGMLDTLSKLGVKTGLSVDKNRLPYLEEYFKTTKPAGTLFEPDYETLNAYKPQLIIIGSRAAKAFDKLNEIAPTIXXTADTANLKESAKEASTLAQIF

SEQ ID NO: 482 - protein, 321 aa, Neisseria
MLRLTALAVCTALALGACSPQNSDSAPQAKEQAVSAAQTEGASVTVKTARGDVQIPQNPERIAVYDLGMLDTLSKLGVKTGLSVDKNRLPYLEEYFKTTKPAGTLFEPDYETLNAYKPQLIIIGSRAAKAFDKLNEIAPTIEMTADTANLKESAKERIDALAQIFGKQAEADKLKAEIDASFEAAKTAAQGKGKGLVILVNGGKMSAFGPSSRLGGWLHKDIGVPAVDESIKEGSHGQPISFEYLKEKNPDWLFVLDRSAAIGEEGQAAKDVLDNPLVAETTAWKKGQVVYLVPETYLAAGGAQELLNASKQVADAFNAAK

SEQ ID NO: 483 - protein, 321 aa, Neisseria
MLRLTALAVCTALALGACSPQNSDSAPQAKEQAVSAAQSEGVSVTVKTARGDVQIPQNPERIAVYDLGMLDTLSKLGVKTGLSVDKNRLPYLEEYFKTTKPAGTLFEPDYETLNAYKPQLIIIGSRAAKAFDKLNEIAPTIEMTADTANLKESAKERIDALAQIFGKKAEADKLKAEIDASFEAAKTAAQGKGKGLVILVNGGKMSAFGPSSRLGGWLHKDIGVPAVDEAIKEGSHGQPISFEYLKEKNPDWLFVLDRSAAIGEEGQAAKDVLNNPLVAETTAWKKGQVVYLVPETYLAAGGAQELLNASKQVADAFNAAK

SEQ ID NO: 484 - protein, 124 aa, Neisseria
MKLLTTAILSSAIALSSMAAAAGTDNPTVAKKTVSYVCQQGKKVKVTYGFNKQGLTTYASAVINGKRVQMPVNLDKSDNVETFYGKEGGYVLGTGVMDGKSYRKQPIMITAPDNQIVFKDCSPR

SEQ ID NO: 485 - protein, 124 aa, Neisseria
MKLLTTAILSSAIALSSMAAAAGTNNPTVAKKTVSYVCQQGKKVKVTYGFNKQGLTTYASAVINGKRVQMPVNLDKSDNVETFYGKEGGYVLGTGVMDGKSYRKQPIMITAPDNQIVFKDCSPR

SEQ ID NO: 486 - protein, 173 aa, Neisseria
  VARIANT (1)...(173): Xaa = Any Amino Acid
GTEFKTTLSGADIQAGVGEKARADAKIILKGIVNRIQTEEKLESNSTVWQKQAGSGSTVETLKLPSFEGPALPKLTAPGGYIADIPKGNLKTEIEKLAKQPEYAYLKQLQTVKDVNWNQVQLAYDKWDYKQEGLTGAGAAIXALAVTVVTSGAGTGAVLGLXRVAAAATDAAF

SEQ ID NO: 487 - protein, 640 aa, Neisseria
MQLLAAEGIHQHQLNVQKSTRFIGIKVGKSNYSKNELNETKLPVRVIAQTAKTRSGWDTVLEGTEFKTTLSGADIQAGVGEKARADAKIILKGIVNRIQTEEKLESNSTVWQKQAGSGSTVETLKLPSFEGPALPKLTAPGGYIADIPKGNLKTEIEKLAKQPEYAYLKQLQTVKDVNWNQVQLAYDKWDYKQEGLTGAGAAIIALAVTVVTSGAGTGAVLGLNGAAAAATDAAFASLASQASVSFINNKGNIGNTLKELGRSSTVKNLMVAVATAGVADKIGASALNNVSDKQWINNLTVNLANAGSAALINTAVNGGSLKDNLEANILAALVNTAHGEAASKIKQLDQHYIAHKIAHAIAGCAAAAANKGKCQDGAIGAAVGEILGETLLDGRDPGSLNVKDRAKIIAKAKLAAGAVAALSKGDVSTAANAAAVAVENNSLNDIQDRLLSGNYALCMSAGGAESFCESYRPLGLPHFVSVSGEMKLPNKFGNRMVNGKLIINTRNGNVYFSVGKIWSTVKSTKSNISGVSVGWVLNVSPNDYLKEASMNDFRNSNQNKAYAEMISQTLVGESVGGSLCLTRACFSVSSTISKSKSPFKDSKIIGEIGLGSGVAAGVEKTIYIGNIKDIDKFISANIKK

SEQ ID NO: 488 - protein, 761 aa, Neisseria
  VARIANT (1)...(761): Xaa = Any Amino Acid
XQLLAEEGIHKHELDVQKSRRFIGIKVGXSNYSKNELNETKLPVRVVAQXAATRSGWDTVLEGTEFKTTLAGADIQAGVXEKARVDAKIILKGIVNRIQSEEKLETNSTVWQKQAGRGSTIETLKLPSFESPTPPKLSAPGGYIVDIPKGNLKTEIEKLSKQPEYAYLKQLQVAKNINWNQVQLAYDRWDYKQEGLTEAGAAIIALAVTVVTSGAGTGAVLGLNGAXAAATDAAFASLASQASVSFINNKGDVGKTLKELGRSSTVKNLVVAAATAGVADKIGASALXNVSDKQWINNLTVNLANAGSAALINTAVNGGSLKDXLEANILAALVNTAHGEAASKIKQLDQHYIVHKIAHAIAGCAAAAANKGKCQDGAIGAAVGEIVGEALTNGKNPDTLTAKEREQILAYSKLVAGTVSGVVGGDVNAAANAAEVAVKNNQLSDXEGREFDNEMTACAKQNXPQLCRKNTVKKYQNVADKRLAASIAICTDISRSTECRTIRKQHLIDSRSLHSSWEAGLIGKDDEWYKLFSKSYTQADLALQSYHLNTAAKSWLQSGNTKPLSEWMSDQGYTLISGVNPRFIPIPRGFVKQNTPITNVKYPEGISFDTNLXRHLANADGFSQEQGIKGAHNRTNXMAELNSRGGXVKSETXTDIEGITRIKYEIPTLDRTGKPDGGFKEISSIKTVYNPKXFXDDKILQMAQXAXSQGYSKASKIAQNERTKSISERKNVIQFSETFDGIKFRXYXDVNTGRITNIHPE

SEQ ID NO: 489 - protein, 111 aa, Neisseria
RIVVGLRISCAVVTVVPSITQGFVFAFHSDKGYDALVGIAVLGTFVHPTHICLRILIAASWLLIFLPSRFSTSRLRASAYLSANAISFGCSCLLFQSTFAPTTAPPLPPVA

SEQ ID NO: 490 - protein, 571 aa, Neisseria
  VARIANT (1)...(571): Xaa = Any Amino Acid
KFDFTWFIPAVIKYRRLFFEVLVVSVVLQLFALITPLFFQVVMDKVLVHRGFSTLDVVSVALLVVSLFEIVLGGLRTYLFAHTTSRIDVELGARLFRHLLSLPLSYFEHRRVGDTVARVRELEQIRNFLTGQALTSVLDLAFSFIFLAVMWYYSSTLTWVVLASLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXICANRTVLIIAHRLSTVKTAHRIIAMDKGRIVEAGTQQELLANXNGYYRYLYDLQNG

SEQ ID NO: 491 - protein, 710 aa, Neisseria
MSIVSAPLPALSALIILAHYHGIAANPADIQHEFCTSAQSDLNETQWLLAAKSLGLKAKVVRQPIKRLAMATLPALVWCDDGNHFILAKTDGEGEHAQFLIQDLVTNKSAVLSFAEFSNRYSGKLILVASRASVLGSLAKFDFTWFIPAVIKYRRLFFEVLVVSVVLQLFALITPLFFQVVMDKVLVHRGFSTLDVVSVALLVVSLFEIVLGGLRTYLFAHTTSRIDVELGARLFRHLLSLPLSYFEHRRVGDTVARVRELEQIRNFLTGQALTSVLDLAFSFIFLAVMWYYSSTLTWVVLASLPAYAFWSAFISPILRTRLNDKFARNADNQSFLVESITAVGTVKAMAVEPQMTQRWDNQLAAYVASGFRVTKLAVVGQQGVQLIQKLVTVATLWIGARLVIESKLTVGQLIAFNMLSGQVAAPVIRLAQLWQDFQQVGISVARLGDILNAPTENASSHLALPDIRGEITFEHVDFRYKADGRLILQDLNLRIRAGEVLGIVGRSGSGKSTLTKLVQRLYVPEQGRVLVDGNDLALAAPAWLRRQVGVVLQENVLLNRSIRDNIALTDTGMPLERIIEAAKLAGAHEFIMELPEGYGTVVGEQGAGLSGGQRQRIAIARALITNPRILIFDEATSALDYESERAIMQNMQAICANRTVLIIAHRLSTVKTAHRIIAMDKGRIVEAGTQQELLAKPNGYYRYLYDLQNG

SEQ ID NO: 492 - protein, 710 aa, Neisseria
MSIVSAPLPALSALIILAHYHGIAANPADIQHEFCTSAQSDLNETQWLLAAKSLGLKAKVVRQPIKRLAMATLPALVWCDDGNHFILAKTDGGGEHAQYLIQDLTTNKSAVLSFAEFSNRYSGKLILVASRASVLGSLAKFDFTWFIPAVIKYRRLFFEVLVVSVVLQLFALITPLFFQVVMDKVLVHRGFSTLDVVSVALLVVSLFEIVLGGLRTYLFAHTTSRIDVELGARLFRHLLSLPLSYFEHRRVGDTVARVRELEQIRNFLTGQALTSVLDLAFSFIFLAVMWYYSSTLTWVVLASLPAYAFWSAFISPILRTRLNDKFARNADNQSFLVESITAVGTVKAMAVEPQMTQRWDNQLAAYVASGFRVTKLAVVGQQGVQLIQKLVTVATLWIGARLVIESKLTVGQLIAFNMLSGQVAAPVIRLAQLWQDFQQVGISVARLGDILNAPTENASSHLALPDIRGEITFEHVDFRYKADGRLILQDLNLRIRAGEVLGIVGRSGSGKSTLTKLVQRLYVPAQGRVLVDGNDLALAAPAWLRRQVGVVLQENVLLNRSIRDNIALTDTGMPLERIIEAAKLAGAHEFIMELPEGYGTVVGEQGAGLSGGQRQRIAIARALITNPRILIFDEATSALDYESERAIMQNMQAICANRTVLIIAHRLSTVKTAHRIIAMDKGRIVEAGTQQELLAKPNGYYRYLYDLQNG

SEQ ID NO: 493 - protein, 62 aa, Neisseria
  VARIANT (1)...(62): Xaa = Any Amino Acid
MKYLIRTALLAVAAAGIYACQPQSEAAVQVKAENSLTAMRLAVADKQAEIDGLNAQXDAEIR

SEQ ID NO: 494 - protein, 86 aa, Neisseria
MKYLIRTALLAVAAAGIYACQPQSEAAVQVKAENSLTAMRLAVADKQAEIDGLNAQIDAEIRQREAEELKDYRWIHGDAEVPELEK

SEQ ID NO: 495 - protein, 92 aa, Neisseria
  VARIANT (1)...(92): Xaa = Any Amino Acid
MVIGILLASSKHALVITLLLNPVFHASSCVSRXAIRNKICCSALAKFAKLFIVSLGAACLAAFAFDNAPTGASQALPTVTAPVAIPAPASAA

SEQ ID NO: 496 - protein, 103 aa, Neisseria
MACTGLMVFPLMVIGILLASSKPAPFLTLLLNPVFHASSCVSRWAIRNKICCSALAKFAKLFIVSLGAACLAAFAFDNAPTGASQALPTVTAPVAIPAPASAA

SEQ ID NO: 497 - protein, 85 aa, Neisseria [sequence omitted]

SEQ ID NO: 498 - protein, 78 aa, Neisseria
VRTWLVFWLQRLKYPLLLWIADMLLYRLLGGAEIECGRCPVPPMTDWQHFLPAMGTVSAWVAVIWAYLMIESEKNGRY

SEQ ID NO: 499 - protein, 78 aa, Neisseria
VRTWLVFWLQRLKYPLLLCIADMLLYRLLGGAEIECGRCPVPPMTDWQHFLPTMGTVAAWVAVIWAYLMIESEKNGRY

SEQ ID NO: 500 - protein, 219 aa, Neisseria
  VARIANT (1)...(219): Xaa = Any Amino Acid
MFQNFDLGVFLLAVLPVLPSITVSHVARGYTARYWGDNTAEQYGRLTLNPLPHIDLVGTIIVPLLTLMFTPFLFGWARPIPIDSRNFRNPRLAWRCVAASGPLSNLAMAVLWGVVLVLTPYVGGAYQMPLAQMANYGILINAILFALNIIPILPWDGGIFIDTFLSAKYSQAFRKIEPYGTWIILLLMLTXVLGAFIAPIXRXRDCXCADVRLTGFQTA

SEQ ID NO: 501 - protein, 212 aa, Neisseria
MFQNFDLGVFLLAVLPVLLSITVREVARGYTARYWGDNTAEQYGRLTLNPLPHIDLVGTIIVPLLTLMFTPFLFGWARPIPIDSRNFRNPRLAWRCVAASGPLSNLAMAVLWGVVLVLTPYVGGAYQMPLAQMANYGILINAILFALNIIPILPWDGGIFIDTFLSAKYSQAFRKIEPYGTWIILLLMLTGVLGAFIAPIVRLVIAFVQMFV

SEQ ID NO: 502 - protein, 185 aa, Neisseria
  VARIANT (1)...(185): Xaa = Any Amino Acid
RGYTARYWGDNTAEQYGRLTLNPLPHIDLVGTIIVPLLTLMFTPFLFGWARPIPIDSRNFRNPRLAWRCVAASGPLSNLAMAVLWGVVLVLTPYVGGAYQMPLAQMANYXILINAILXALNIIPILPWDGGIFIDTFLSAKXSQAFRKIEPYGTWIIXLLMLTGVLGAXIAPIVQLVIAFVQMFV

SEQ ID NO: 503 - protein, 166 aa, Neisseria; identical to SEQ ID NO: 474

SEQ ID NO: 504 - protein, 326 aa, Neisseria; identical to SEQ ID NO: 475
  VARIANT (1)...(326): Xaa = Any Amino Acid

SEQ ID NO: 505 - protein, 356 aa, Neisseria; identical to SEQ ID NO: 476
  VARIANT (1)...(356): Xaa = Any Amino Acid

SEQ ID NO: 506 - protein, 284 aa, Neisseria
  VARIANT (1)...(284): Xaa = Any Amino Acid
AVAETANSQGKGKQAGSSVSVSLKTSGDLCGKLKTTLKTLVCSLVSLSMVLPAHAQITTDKSAPKNQQVVILKTNTGAPLVNIQTPNGRGLSHNRXYAFDVDNKGAVLNNDRNNNPFVVKGSAQLILNEVRGTASKLNGIVTVGGQKADVIIANPNGITVNGGGFKNVGRGILTTGAPQIGKDGALTGFDVVKAHWTVXAAGWNDKGGAXYTGVLARAVALQGKXXGKXLAVSTGPQKVDYASGEISAGTAAGTKPTIALDTAALGGMYADSITLIANEKGVGV

SEQ ID NO: 507 - protein, 1978 aa, Neisseria
MNKGLHRIIFSKKHSTMVAVAETANSQGKGKQAGSSVSVSLKTSGDLCGKLKTTLKTLVCSLVSLSMVLPAHAQITTDKSAPKNQQVVILKTNTGAPLVNIQTPNGRGLSHNRYTQFDVDNKGAVLNNDRNNNPFVVKGSAQLILNEVRGTASKLNGIVTVGGQKADVIIANPNGITVNGGGFKNVGRGILTTGAPQIGKDGALTGFDVRQGTLTVGAAGWNDKGGADYTGVLARAVALQGKLQGKNLAVSTGPQKVDYASGEISAGTAAGTKPTIALDTAALGGMYADSITLIANEKGVGVKNAGTLEAAKQLIVTSSGRIENSGRIATTADGTEASPTYLSIETTEKGAAGTFISNGGRIESKGLLVIETGEDISLRNGAVVQNNGSRPATTVLNAGHNLVIESKTNVNNAKGPATLSADGRTVIKEASIQTGTTVYSSSKGNAELGNNTRITGADVTVLSNGTISSSAVIDAKDTAHIEAGKPLSLEASTVTSDIRLNGGSIKGGKQLALLADDNITAKTTNLNTPGNLYVHTGKDLNLNVDKDLSAASIHLKSDNAAHITGTSKTLTASKDMGVEAGSLNVTNTNLRTNSGNLHIQAAKGNIQLRNTKLNAAKALETTALQGNIVSDGLHAVSADGHVSLLANGNADFTGHNTLTAKADVNAGSVGKGRLKADNTNITSSSGDITLVAGNGIQLGDGKQRNSINGKHISIKNNGGNADLKNLNVHAKSGALNIHSDRALSIENTKLESTHNTHLNAQHERVTLNQVDAYAHRHLSITGSQIWQNDKLPSANKLVANGVLALNARYSQIADNTTLRAGAINLTAGTALVKRGNINWSTVSTKTLEDNAELKPLAGRLNIEAGSGTLTIEPANRISAHTDLSIKTGGKLLLSAKGGNAGAPSAQVSSLEAKGNIRLVTGETDLRGSKITAGKNLVVATTKGKLNIEAVNNSFSNYFPTQKAAELNQKSKELEQQIAQLKKSSPKSKLIPTLQEERDRLAFYIQAINKEVKGKKPKGKEYLQAKLSAQNIDLISAQGIEISGSDITASKKLNLHAAGVLPKAADSEAAAILIDGITDQYEIGKPTYKSHYDKAALNKPSRLTGRTGVSIHAAAALDDARIIIGASEIKAPSGSIDIKAHSDIVLEAGQNDAYTFLKTKGKSGKIIRKTKFTSTRDHLIMPAPVELTANGITLQAGGNIEANTTRFNAPAGKVTLVAGEELQLLAEEGIHKHELDVQKSRRFIGIKVGKSNYSKNELNETKLPVRVVAQTAATRSGWDTVLEGTEFKTTLAGADIQAGVGEKARADAKIILKGIVNRIQSEEKLETNSTVWQKQAGRGSTIETLKLPSFESPTPPKLTAPGGYIVDIPKGNLKTEIEKLAKQPEYAYLKQLQVAKNVNWNQVQLAYDKWDYKQEGLTRAGAAIVTIIVTALTYGYGATAAGGVAASGSSTAAAAGTAATTTAAATTVSTATAMQTAALASLYSQAAVSIINNKGDVGKALKDLGTSDTVKQIVTSALTAGALNQMGADIAQLNSKVRTELFSSTGNQTIANLGGRLATNLSNAGISAGINTAVNGGSLKDNLGNAALGALVNSFQGEAASKIKTTFSDDYVAKQFAHALAGCVSGLVQGKCKDGAIGAAVGEIVADSMLGGRNPATLSDAEKHKVISYSKIIAGSVAALNGGDVNTAANAAEVAVVNNALNFDSTPTNAKKHQPQKPDKTALEKIIQGIMPAHAAGAMTNPQDKDAAIWISNIRNGITGPIVITSYGVYAAGWTAPLIGTAGKLAISTCMANPSGCTVMVTQAAEAGAGIATGAVTVGNAWEAPVGALSKAKAAKQAIPTQTVKELDGLLQESKNIGAVNTRINIANSTTRYTPMRQTGQPVSAGFEHVLEGHFHRPIANNRSVFTISPNELKVILQSNKVVSSPVSMTPDGQYMRTVDVGKVIGTTSIKEGGQPTTTIKVFTDKSGNLITTYPVKGN

SEQ ID NO: 508 - protein, 1532 aa, Neisseria
  VARIANT (1)...(1532): Xaa = Any Amino Acid
MNKGLHRIIFSKKHSTMVAVAETANSQGKGKQAGSSVSVSLKTSGDLCGKLKTTLKTLVCSLVSLSMXXXXXXQITTDKSAPKNXQVVILKTNTGAPLVNIQTPNGRGLSHNRYTQFDVDNKGAVLNNDRNNNPFLVKGSAQLILNEVRGTASKLNGIVTVGGQKADVIIANPNGITVNGGGFKNVGRGILTIGAPQIGKDGALTGFDVRQGTLTVGAAGWNDKGGADYTGVLARAVALQGKLQGKNLAVSTGPQKVDYASGEISAGTAAGTKPTIALDTAALGGMYADSITLIAXEKGVGVKNAGTLEAAKQLIVTSSGRIENSGRIATTADGTEASPTYLXIETTEKGAXGTFISNGGRIESKGLLVIETGEDIXLRNGAVVQNNGSRPATTVLNAGHNLVIESKTNVNNAKGSXNLSAGGRTTINDATIQAGSSVYSSTKGDTXLGENTRIIAENVTVLSNGSIGSAAVIEAKDTAHIESGKPLSLETSTVASNIRLNNGNIKGGKQLALLADDNITAKTTNLNTPGNLYVHTGKDLNLNVDKDLSAASIHLKSDNAAHITGTSKTLTASKDMGVEAGLLNVTNTNLRTNSGNLHIQAAKGNIQLRNTKLNAAKALETTALQGNIVSDGLHAVSADGHVSLLANGNADFTGHNTLTAKADVXAGSVGKGRLKADNTNITSSSGDITLVAXXGIQLGDGKQRNSINGKHISIKNNGGNADLKNLNVHAKSGALNIHSDRALSIENTKLESTHNTHLNAQHERVTLNQVDAYAHRHLSIXGSQIWQNDKLPSANKLVANGVLAXNARYSQIADNTTLRAGAINLTAGTALVKRGNINWSTVSTKTLEDNAELKPLAGRLNIEAGSGTLTIEPANRISAHTDLSIKTGGKLLLSAKGGNAGAXSAQVSSLEAKGNIRLVTGXTDLRGSKITAGKNLVVATTKGKLNIEAVNNSFSNYFXTQKXXXLNQKSKELEQQIAQLKKSSXKSKLIPTLQEERDRLAFYIQAINKEVKGKKPKGKEYLQAKLSAQNIDLISAQGIEISGSDITASKKLNLHAAGVLPKAADSEAAAILIDGITDQYEIGKPTYKSHYDKAALNKPSRLTGRTGVSIHAAAALDDARIIIGASEIKAPSGSIDIKAHSDIVLEAGQNDAYTFLXTKGKSGXXIRKTKFTSTXXHLIMPAPVELTANGITLQAGGNIEANTTRFNAPAGKVTLVAGEXXQLLAEEGIHKHELDVQKSRRFIGIKVGXSNYSKNELNETKLPVRVVAQXAATRSGWDTVLEGTEFKTTLAGADIQAGVXEKARVDAKIILKGIVNRIQSEEKLETNSTVWQKQAGRGSTIETLKLPSFESPTPPKLSAPGGYIVDIPKGNLKTEIEKLSKQPEYAYLKQLQVAKNINWNQVQLAYDRWDYKQEGLTEAGAAIIALAVTVVTSGAGTGAVLGLNGAXAAATDAAFASLASQASVSFINNKGDVGKTLKELGRSSTVKNLVVAAATAGVADKIGASALXNVSDKQWINNLTVNLANXGQCRTD

SEQ ID NO: 509 - protein, 593 aa, Neisseria
  VARIANT (1)...(593): Xaa = Any Amino Acid
RFIHDEAVGSNIGGGKMIVAAGQDINVRGXSLISDKGIVLKAGHDIDISTAHNRYTGNEYHESXXSGVMGTGGLGFTIGNRKTTDDTDRTNIVHTGSIIGSLNGDTVTVAGNRYRQTGSTVSSPEGRNTVTAKXIDVEFANNRYATDYAHTQEQKGLTVALNVPVVQAAQNFIQAAQNVGKSKNKRVNAMAAANAAWQSYQATQQMQQFAPSSSAGQGQNYNQSPSISVSIXYGEQKSRNEQKRHYTEAAASQIIGKGQTTLAATGSGEQSNINITGSDVIGHAGTXLIADNHIRLQSAKQDGSEQSKNKSSGWNAGVRXKIGNGIRFGITAGGNIGKGKEQGGSTTHRHTHVGSTTGKTTIRSGGDTTLKGVQLIGKGIQADTRNLHIESVQDTETYQSKQQNGNVQVTVGYGFSASGSYRQSKVKADHASVTGQSGIYAGEDGYQIKVRDNTDLKGGIITSSQSAEDKGKNLFQTATLTASDIQNHSRYEGRSFGIGGSFDLNGGWDGTVTDKQGRPTDRISPAAGYGSDGDSKNSTTRSGVNTHNIHITDEAGQLARTGRTAKETEARIYTGIDTETADQHSGHLKNSFD

SEQ ID NO: 510 - protein, 129 aa, Neisseria
TTGSLGGILAGGGTSLAAPYLDKAAENLGPAGKAAVNALGGAAIGYATGGSGGAVVGANVDWNNRQLHPKEMALADKYAEALKREVEKREGRKISSQEAAMRIRRQICVGWTKVPKTAIPTKASYPLSE

SEQ ID NO: 511 - protein, 319 aa, Neisseria
  VARIANT (1)...(319): Xaa = Any Amino Acid
QCRLKSSQFYRRHLLCKYIYRFPIYCPXACVAEDTPYACYLXQLQVTKDVNWNQVXLAYDKWDYKQEGLTGAGAAIIALAVTVVTAGAGAGAALGLNGAAAAATDAAFASLASQASVSLINNKGNIGNTLKELGRSSTVKNLMVAVATAGVADKIGASALNNVSDKQWINNLTVNLANAGSAALINTAVNGGSLKDNLEANILAALVNTAHGEAASKIKQLDQHYITHKIAHAIAGCAAAAANKGKCQDGAIGAAVGEIVGEALTNGKNPDTLTAKEREQILAYSKLVAGTVSGVVGGDVNAAANAAEVAVKNNQLSDK

SEQ ID NO: 512 - protein, 619 aa, Neisseria
MQVNIQIPYILPRCVRAEDTPYACYLKQLQVTKDVNWNQVQLAYDKWDYKQEGLTGAGAAIIALAVTVVTAGAGAGAALGLNGAAAAATDAAFASLASQASVSLINNKGNIGNTLKELGRSSTVKNLMVAVATAGVADKIGASALNNVSDKQWINNLTVNLANAGSAALINTAVNGGSLKDNLEANILAALVNTAHGEAASKIKQLDQHYITHKIAHAIAGCAAAAANKGKCQDGAIGAAVGEIVGEALTNGKNPDTLTAKEREQILAYSKLVAGTVSGVVGGDVNAAANAAEVAVKNNQLSDKEGREFDNEMTACAKQNNPQLCRKNTVKKYQNVADKRLAASIAICTDISRSTECRTIRKQHLIDSRSLHSSWEAGLIGKDDEWYKLFSKSYTQADLALQSYHLNTAAKSWLQSGNTKPLSEWMSDQGYTLISGVNPRFIPIPRGFVKQNTPITNVKYPEGISFDTNLKRHLANADGFSQKQGIKGAHNRTNFMAELNSRGGRVKSETQTDIEGITRIKYEIPTLDRTGKPDGGFKEISSIKTVYNPKKFSDDKILQMAQNAASQGYSKASKIAQNERTKSISERKNVIQFSETFDGIKFRSYFDVNTGRITNIHPE

SEQ ID NO: 513 - protein, 595 aa, Neisseria
  VARIANT (1)...(595): Xaa = Any Amino Acid
YLKQLQVAKNINWNQVQLAYDRWDYKQEGLTEAGAAIIALAVTVVTSGAGTGAVLGLNGAXAAATDAAFASLASQASVSFINNKGDVGKTLKELGRSSTVKNLVVAAATAGVADKIGASALXNVSDKQWINNLTVNLANAGSAALINTAVNGGSLKDXLEANILAALVNTAHGEAASKIKQLDQHYIVHKIAHAIAGCAAAAANKGKCQDGAIGAAVGEIVGEALTNGKNPDTLTAKEREQILAYSKLVAGTVSGVVGGDVNAAANAAEVAVKNNQLSDXEGREFDNEMTACAKQNXPQLCRKNTVKKYQNVADKRLAASIAICTDISRSTECRTIRKQHLIDSRSLHSSWEAGLIGKDDEWYKLFSKSYTQADLALQSYHLNTAAKSWLQSGNTKPLSEWMSDQGYTLISGVNPRFIPIPRGFVKQNTPITNVKYPEGISFDTNLXRHLANADGFSQEQGIKGAHNRTNXMAELNSRGGXVKSETXTDIEGITRIKYEIPTLDRTGKPDGGFKEISSIKTVYNPKXFXDDKILQMAQXAXSQGYSKASKIAQNERTKSISERKNVIQFSETFDGIKFRXYXDVNTGRITNIHPE

SEQ ID NO: 514 - protein, 150 aa, Neisseria
  VARIANT (1)...(150): Xaa = Any Amino Acid
MAIITLYYSVNGILNVCAKAKNIQVVANNKNMVLFGFLXXIIGGSTNAMSPILLIFLLSETENKNRIVKSSNLCYLLAKIVQIYMLRDQYWLLNKSEYXLIFLLSVLSVIGLYVGIRLRTKISPNFFKMLIFIVLLVLALKIGHSGLIKL

SEQ ID NO: 515 - protein, 255 aa, Neisseria
MQEIMQSIVFVAAAILHGITGMGFPMLGTTALAFIMPLSKVVALVALPSLLMSLLVLCSNNKKGFWQEIVYYLKTYKLLAIGSVVGSILGVKLLLILPVSWLLLLMAIITLYYSVNGILNVCAKAKNIQVVANNKNMVLFGFLAGIIGGSTNAMSPILLIFLLSETENKNRIVKSSNLCYLLAKIVQIYMLRDQYWLLNKSEYGLIFLLSVLSVIGLYVGIRLRTKISPNFFKMLIFIVLLVLALKIGHSGLIKL

SEQ ID NO: 516 - protein, 255 aa, Neisseria
MQEIMQSIVFVAAAILHGITGMGFPMLGTTALAFIMPLSKVVALVALPSLLMSLLVLCSNNKKGFWQEIVYYLKTYKLLAIGSVVGSILGVKLLLILPVSWLLLLMAIITLYYSVNGILNVCAKAKNIQVVANNKNMVLFGFLAGIIGGSTNAMSPILLIFLLSETENKNRIAKSSNLCYLLAKIVQIYMLRDQYWLLNKSEYGLIFLLSVLSVIGLYVGIRLRTKISPNFFKMLIFIVLLVLALKIGYSGLIKL

SEQ ID NO: 517 - protein, 172 aa, Neisseria
MRHMKIQNYLLVFIVLHIALIVINIVFGYFVFLFDFFAFLFFANVFLAVNLLFLEKNIKNKLLFLLPISIIIWMVIHISMINIKFYKFEHQIKEQNISSITGVIKPHDSYNYVYDSNGYAKLKDNHRYGRVIRETPYIDVVASDVKNKSIRLSLVCGIHSYAPCANFIKFVR

SEQ ID NO: 518 - protein, 242 aa, Neisseria
MRHMKNKNYLLVFIVLHIALIVINIVFGYFVFLFDFFAFLFFANVFLAVNLLFLEKNIKNKLLFLLPISIIIWMVIHISMINIKFYKFEHQIKEQNISSITGVIKPHDSYNYVYDSNGYAKLKDNHRYGRVIRETPYIDVVASDVKNKSIRLSLVCGIHSYAPCANFIKFAKKPVKIYFYNQPQGDFIDNVIFEINDGNKSLYLLDKYKTFFLIENSVCIVLIILYLKFNLLLYRTYFNELE

SEQ ID NO: 519 - protein, 242 aa, Neisseria
MRHMKNKNYLLVFIVLHITLIVINIVFGYFVFLFDFFAFLFFANVFLAVNLLFLEKNIKNKLLFLLPISIIIWMVIHISMINIKFYKFEHQIKEQNISSITGVIKPHDSYNYVYDSNGYAKLKDNHRYGRVIRETPYIDVVASDVKNKSIRLSLVCGIHSYAPCANFIKFAKKPVKIYFYNQPQGDFIDNVIFEINDGKKSLYLLDKYKTFFLIENSVCIVLIILYLKFNLLLYRTYFNELE

SEQ ID NO: 520 - protein, 183 aa, Neisseria
TPNSVTVLPSFGGFGRTGATINAAGGVGMTAFSTTLISVAEGAVVELQAVRAKAVNATAACIFTVLSKDIFDFLFIFRFQTADFRLYFRQSHADSVRLDFIFKSFRACQFQFARIVLSRQQQGLRLVALHLVDDRLQLRKCRLVALMVRHSQARADKRDNGNRLPVIRQQFHEIHSRPPDASR

SEQ ID NO: 521 - protein, 155 aa, Neisseria
MTAFSTTLISVAEGAVVELQAVRAKAVNATAACIFTVLSKDIFDFLFIFRFQTADFRLFFRQSHADSVRLDFIFFSFRACQFQFARIVLSRQQQGLRLVALHLVDDRLLLRKCRLVALMVRHSQARADKRDNGNRLPVIRQQFHEIHSRPPDASR

SEQ ID NO: 522 - protein, 153 aa, Neisseria
MTAFSTTLISVAEGALVELQAVMAKAVNTTAACIFTVLSKDIFDFLFIFRFQTADFRLFFRQSHADGVRLDFIFFSFRTRLFQFAGVVLSRQQQGLRLVALHFLNDRLLLRKSRLVALMVRHRQTRADKRDDGNRLPVIRQQFHEIHSRPPDV

SEQ ID NO: 523 - protein, 131 aa, Neisseria
MLPQGKAARRVSANEVSGRACARMVLVICQTLPKRDTLNGSGTHTLPVWAILPRSLRSKSTIITFSARFFGSVCNSAARRSSCPSPKIGAVPFIGSVLMVPSEAMLRKSSGEKHSVHADCPASSGRWDNTA

SEQ ID NO: 524 - protein, 131 aa, Neisseria
  VARIANT (1)...(131): Xaa = Any Amino Acid
MLPQGKAARRMSANEVCGXLXAWXVLVICQTLPKRDTLNGSGTHTVPVWAILPRSLRSKSTIITFSARFFGSACNSAARRSSCPSPKIGAVPFIGSVLMVPSEPILRKSSGEKHSVHADCPSASGRWDKTA

SEQ ID NO: 525 - protein, 131 aa, Neisseria
MLPQGKAARRMSANEVCGKAWAWMVLVICQTLPKRDTLNGSGTHTVPVWAILPRSLRSKSTIITFSARFFGSACNSAARRSSCPSPKIGAVPFIGSVLMVPSEPILRKSSGEKHSVHADCPCASGRWDKTA

SEQ ID NO: 526 - protein, 219 aa, Neisseria
MVVFVAEGVFGRAVLGHLVLLFGQGAFEFGVTRFFIRCRVEAFALRCGFGFARQRFVGFADVDVAVAVGVFNQVVLMVFLGVVEVFQRFVFNNEGQLVFLLLAFEGGGDDGFFGGVGVVHAAAVLRAGVVTLFVEAGRINDAEIILQDVVQAEFVGIVGHFDGLGMTRMAVGHFFVRVFRVAVGVTGYRVNHAVDALEIGFQAPKAAAGEVNGARVHDC

SEQ ID NO: 527 - protein, 219 aa, Neisseria
  VARIANT (1)...(219): Xaa = Any Amino Acid
MVVFVAEGIFGRAVLGNLXLLFGQGAFEFGVTRFFIRCRVEAFALRGGLGFARQRFVSXADVDVAVAVGVFNQVVLMVFLGIVEVFQRLVFNNEGQLVFLLLAFEGXGDDGFFXGVGVVHAAAVLRTGVVALFVEAGRINDAEEILQDVVAEFVGIVGHFDGFGVARMAVGHVFIARIFRVAVGVAGYRVNHAVDALEIGFQAPEAAXGEVNGARVHDF

SEQ ID NO: 528 - protein, 219 aa, Neisseria
MVVFVAEGIFGRAVLGNLVLLFGQGAFEFGVTRFFIRCRVEAFALRCGLGFARQRFVGFADIDVAVAVGVFNQVVLMVFLGIVEVFQRLVFNNEGQLVFLLLAFEGGGDDGFFGGVGVVHAAAVLRTGVVALFVEAGRINDAEEILQDVVAEFVGIVGHFDGFGVARMAVGHVFIARIFRVAVGVAGYRVNHAVDALEIGFQAPEAAAGEVDGARVHDF

SEQ ID NO: 529 - protein, 258 aa, Neisseria
MVERHIQHLRNGHLHLMRPCQQVSQMFGGRAYDFRADKAAGGFFGIQAHMAFVYQHHAAATLIFERYFADDKFVGLVLRGNLRVFQTDKADLRTGKHHANGAAAQTAADIRVAAPRYCPAILPWSAASCSRGSWLDASPAIKICGMLVCMVSGSATGTPRASLSILMFSKPILSTFGRRPTAANIYSATNTPFSPSCSQWTSTLPSASSLTSVLASRCSFNSSPNTAFASSETTGSEMPPMIPPKPKISTFTPKRCNA

SEQ ID NO: 530 - protein, 257 aa, Neisseria
MVERHIQHLRNGHLHLMCPSQQVRQMFGGRAYDFRADKAAGGFFGIQAHMAFVHQHHAAAALVFERYFADDKFVGLVLRGNLRVFQTDKADLRTGKHHADGAAPQTAADIRVAAALSPAILPWSAASCSRGSWLDASPAMKICGILVCMVSGSATGTPRASFSILIFSKPILSTFGRRPTAASIYSATNTPFSPSCSQWTSTLPSASSLTSVLASRCSFNSSPNTAFASSETTGSEMPPMIPPKPKISTFTPKRCNA

SEQ ID NO: 531 - protein, 257 aa, Neisseria
MVERHIQHLRNGHLHLMCPSQQVRQMFGGRTYDFCADEAAGGFFGIQAHMAFVYQHHAAAALVFERYFADDKFVGLVLRGNLRVFQTDKADLRTGEHYADGAAAQTAADIRVAAALSPAILPWSAASCSRGSWLDASPAIKICGILVCIVSGSATGTPRASFSILMFSKPILSTFGRRPTAASIYSATNTPFSPSCSQWTSTLPSASSLASVLASKCSFNSSPNTAFASSETTGSEMPPMMPPKPKISTFTPKRCNA

SEQ ID NO: 532 - protein, 368 aa, Neisseria
MGMDNIDMFMPEQEEIQSMWKEILLNYGIFLLELLTVFGAIALIVLAIVQSKKQSESGSVVLTDFSENYKKQRQSFETFFLSEEETKHQEKKEKKKEKAEAKAEKKRLKEGGEKSAETQKSRLFVLDFDGDLYAHAVESLRHEITAVLLIAKPEDEVLLRLESPGGVVHGYGLAASQLRRLRERNIPLTVAVDKVAASGGYMMACVADKIVSAPFAVIGSVGVVAEVPNIHRLLKKHDIDVDVMTAGEFKRTVTFMGENTEKGKQKFRQELEETHQLFKQFVSENRPGLDIEKIATGEHWFGRQALALNLIDEISTSDDLLLKAFENKQVIEVKYQEKRSLIQRIGLQAEASVEKLFAKLVNRRADVM

SEQ ID NO: 533 - protein, 366 aa, Neisseria
  VARIANT (1)...(366): Xaa = Any Amino Acid
MDNIDMFMPEQEEIQSMWKEILLNYGIFLLELLTVFGAIALIVLAIVQSKKQSXSGSVVLTDFSENYKKQRQSFEAFFLSGEEAQHQEKEEKKKEKAEAKAEKXRLKEGGEKSAETXKSRLFVLXXXXXXXXXXXXXXXXXXXXXXXXXXXXXXXXXXXXXXXXXXXXXXXXXXXXXXXXXXXXXXXXXXXXXXASGGYMMACVADKIASAPFAIVGSVGVVAEVPNIHRLLKKHDIDVDVMTAGEFKRTVTFMGENTEKGKQKFRQELEETHQLFKQFVSENRPQLDIEEVATGEHWFGRQALALNLIDEISTSDDLLLKAFENKQVIEVKYQEKQSLIQRIGLQAEASVEKLFAKLVNRRADVM

SEQ ID NO: 534 - protein, 366 aa, Neisseria
MDNIDMFMPEQEEIQSMWKEILLNYGIFLLELLTVFGAIALIVLAIVQSKKQSESGSVVLTDFSENYKKQRQSFEAFFLSGEEAKHQEKEEKKKEKAEAKAEKKRLKEGGEKSSETQKSRLFVLDFDGDLYAHAVESLRHEITAVLLIAKPEDEVLLRLESPGGVVHGYGLAASQLRRLRERNIPLTVAVDKVAASGGYMMACVADKIVSAPFAIVGSVGVVAEVPNIHRLLKKHDIDVDVMTAGEFKRTVTFMGENTEKGKQKFRQELEETHQLFKQFVSENRPQLDIEEVATGEHWFGRQALALNLIDEISTSDDLLLKAFENKQVIEVKYQEKQSLIQRIGLQAEASVEKLFAKLVNRRADVM

SEQ ID NO: 535 - protein, 153 aa, Neisseria
MLLVLEFWFGVSAVGILALFLWLLPRFAAISENLYFRLNNSLERDNHFIRKGDERQLYRHYGLVSRLRVLISNREAFGYLCVGAAMGILFGFAFVMMTLKGYGSAGHIYSVGTYLWMFAMSLDDVPRLVEQYSNLKDIGQRIEWSERNIKAGT

SEQ ID NO: 536 - protein, 153 aa, Neisseria
MLLVLEFWVGVSAVGILALFLWLLPRFAAISENLYFRLNNSLERDNHFIRKGDRRQLYRHYGLLARLRVLISNREAFGYLCVGTAMGILFGFAFVMMTLKGYSSAGHVYSVGTYLWMFAMSLDDVPRLVEQYSNLKDIGQRIEWSERNIKAGT

SEQ ID NO: 537 - protein, 153 aa, Neisseria
MLLVLEFWVGVSAVGILALFLWLLPRFAAISENLYFRLKNSLERDNHFIRKGDERQLDRHYGLLARLRVLISNREAFGYLCVGTAMGILFGFAFVMMTLKGYSSAGHVYSVGTYLWMFAISLDDVPRLVEQYSNLKDIGQRIEWSKRNIKAGT

SEQ ID NO: 538 - protein, 288 aa, Neisseria
MWKMLKHIAKTHRKRLIGTFSPVGLENLLMLGYPVFGGWAINAVIAGRVWQALLYALVVFLMWLVGAARRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLNNSLERDNHFIRKGDERQLYRHYGLVSRLRVLISNREAFGYLCVGAAMGILFGFAFVMMTLKGYGSAGHIYSVGTYLWMFAMSLDDVPRLVEQYSNLKDIGQRIEWSERNIKAGT

SEQ ID NO: 539 - protein, 288 aa, Neisseria
MWKMLKHIAQTHRKRLIGTFSLVGLENLLMLVYPVFGGRAINAVIAGEVWQALLYALVVLLMWLVGAVRRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLNNSLERDNHFIRKGDRRQLYRHYGLLARLRVLISNREAFGYLCVGTAMGILFGFAFVMMTLKGYSSAGHVYSVGTYLWMFAMSLDDVPRLVEQYSNLKDIGQRIEWSERNIKAGT

SEQ ID NO: 540 - protein, 280 aa, Neisseria
SQNHRKRLIGTFFLVGLENLLMLVYPVFGGWAINAVIAGQAWQALLYALVVLLMWLVGAARRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLKNSLERDNHFIRKGDERQLDRHYGLLARLRVLISNREAFGYLCVGTAMGILFGFAFVMMTLKGYSSAGHVYSVGTYLWMFAISLDDVPRLVEQYSNLKDIGQRIEWSKRNIKAGT

SEQ ID NO: 541 - protein, 113 aa, Neisseria
MNTTRLPTAFILCCLCAAASAADNSIMTKGQKVYESNCIACHGKKGEGRGTAFPPLFRSDCIMNKPHVLLHSMVKGIDGTFKVERQNLRRIYARNRHQRCGHCRRRHLYHERL

SEQ ID NO: 542 - protein, 113 aa, Neisseria
  VARIANT (1)...(113): Xaa = Any Amino Acid
MNTTRLPTALVLGCFCAAASAADNSIMTKGQKVYESNCVACHGKKGEGRGTMFPPLYRSDFIMKKPQVLLHSMVKGINGTIKVXRQNLQRIHARNRHQRCGHCRRRHLYHERL

SEQ ID NO: 543 - protein, 341 aa, Neisseria
ATGAACACAACCCGACTGCCGACCGCCCTCGTCTTGGGCTGCCTCTGCGCCGCCGCTTCTGCCGCCGACAACAGCATCATGACAAAAGGGCAAAAAGTGTACGAATCCAACTGCGTCGCCTGCCACGGCAAAAAGGGCGAAGGCCGCGGAACCATGTTTCCGCCGCTCTACCGCTCCGACTTCATCATGAAAAAACCGCAGGTGCTGCTGCACAGCATGGTCAAAGGCATCAACGGTACAATCAAAGTCAACGGCAAAACCTACAACGGATTCATGCCCGCCACTGCCATCAGCGATGCGGACATTGCCGCCGTCGCCACTTATATCATGAACGCCTTTGA

SEQ ID NO: 544 - protein, 133 aa, Neisseria
MNTTRLPTAFILCCLCAAASAADNSIMTKGQKVYESNCIACHGKKGEGRGTAFPPLFRSDYIMNKPHVLLHSMVKGINGTIKVNGKTYNGFMPATAISDADIAAVATYIMNAFDNGGGSVTEKDVKQAKGKKN

SEQ ID NO: 545 - protein, 133 aa, Neisseria
MNTTRLPTALVLGCFCAAASAADNSIMTKGQKVYESNCVACHGKKGEGRGTMFPPLYRSDFIMKKPQVLLHSMVKGINGTIKVNGKTYNGFMPATAISDADIAAVATYIMNAFDNGGGSVTEKDVKQAKSKKN

SEQ ID NO: 546 - protein, 132 aa, Neisseria
MNTTRLPTALVLGCLCAAASAADNSIMTKGQKVYESNCVACHGKKGEGRGTMFPPLYRSDFIMKKPQVLLHSMVKGINGTIKVNGKTYNGFMPATAISDADIAAVATYIMNAFDNGGGSVTEKDVKQAKNKK

SEQ ID NO: 547 - protein, 164 aa, Neisseria
MNNRHFAVIALGSNLDNPAQQIRGALDALSSHPDIRLEQVSSLYMTAPVGYDNQPDFINAVCTVSTTLDGIALLAELNRIEADFGRERSFRNAPRTLDLDIIDFDGISSDDPRLTLPHPRAHERSFVIRPLAEILPDFILGKYGKVVELSKRLGNQGIRLLPDR

SEQ ID NO: 548 - protein, 164 aa, Neisseria
  VARIANT (1)...(164): Xaa = Any Amino Acid
MNNRHFAVIALGSNLENPAQQVRAALDTLSSHPDIRLKQASSLYMTAPVGYDNQPDFVNAVCTVSTTLDGIALLAELNRIEADFGRERSFRNAPRTLXLDIIDFDGISSDDTRLTLPHPRAHERSFVIRPLAEILPDFVLGKHGKVAELSKRLGNQGIRLLPDR

SEQ ID NO: 549 - protein, 164 aa, Neisseria
MNNRHFAVIALGSNLENPAQQVRAALDTLSSHPDIRLKQASSLYMTAPVGYDNQPDFVNAVCTVSTTLDGIALLAELNRIEADFGRERSFRNAPRTLDLDIIDFDGISSDDPRLTLPHPRAHERSFVIRPLAEILPDFILGKHGKVAELSKRLGNQGIRLLPDK

SEQ ID NO: 550 - protein, 86 aa, Neisseria
MPRAAVAFERHHHKSKAEQNTHRRADAEIAEGFAVGNQHTQARNQSVMAVQLPLVAFSDKVVVAFQAVVQAEIQVFADGGKTWQKP

SEQ ID NO: 551 - protein, 86 aa, Neisseria
MPRAAVAFERHHHKSKAEQNTHRRADAEIAEGFAVGNQHTQARKQSVMAVQLPPVAFSDKVVVAFQAVVQAEIQVFADGGKTWQKP

SEQ ID NO: 552 - protein, 86 aa, Neisseria
MPRAAVAFERHHHKSKAEQNTHRRADAEIAEGFAVGNQHTQARKQSVMAVQLPLVAFSDKVVVAFQAVLQAEIQVFADGGKTWQKP

SEQ ID NO: 553 - protein, 415 aa, Neisseria
MGFPVRKFDAVIVGGGGAGLRAALQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGDEYEVPVKGLYAAGECACASVHGANRLGTNSLLDLVVFRPTPR

SEQ ID NO: 554 - protein, 202 aa, Neisseria
  VARIANT (1)...(202): Xaa = Any Amino Acid
XQLSKSGLNCAVLSKVFPTRSHTVAAQGGISASXGNVQEDRWDWHMYDTVKGSDWLGDQDAIEFMCRAAPEAVIELEHMGMPFDRVESGKIYQRPFCAVADRTGHAMLHTLYQQNVRANTQFFVEWTAQDLIRDENGDVVGVTAMEMETGEVYIFHAKAVMFATGGGGRIYASSTNGIPLEDMEFWQFQPTGVAGAGVLITE

SEQ ID NO: 555 - protein, 587 aa, Neisseria
  VARIANT (1)...(587): Xaa = Any Amino Acid
MGFPVRKFDAVIVGGGGAGLRAXLQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGDEYEVPVKGLYAAGECACASVHGANRLGTNSLLDLVVFGKAAGDSMIKFIKEQSDWKPLPANAGELTRQRIERLDNQTDGENVDALRRELQRSVQLHAGVFRTDEILSKGVREVMAIAERVKRTEIKDKSKVWNTARIEALELDNLIEVAKATLVSAEARKESRGAHASDDHPERDDENWMKHTLYHSDANTLSYKPVHTKPLSVEYIKPAKRVY

SEQ ID NO: 556 - protein, 415 aa, Neisseria; identical to SEQ ID NO: 553

SEQ ID NO: 557 - protein, 587 aa, Neisseria
MGFPVRKFDAVIVGGGGAGLRAALQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGEDYEVPVKGLYAAGECACASVHGANRLGTNSLLDLVVFGKAAGDSMIKFIKEQSDWKPLPANAGELTRQRIERLDNQTDGENVDALRRELQRSVQLHAGVFRTDEILSKGVREVMAIAERVKRTEIKDKSKVWNTARIEALELDNLIEVAKATLVSAEARKESRGAHASDDHPERDDENWMKHTLYHSDINTLSYKPVHTKPLSVEYIKPAKRVY

SEQ ID NO: 558 - protein, 587 aa, Neisseria; identical to SEQ ID NO: 555
  VARIANT (1)...(587): Xaa = Any Amino Acid

SEQ ID NO: 559 - protein, 180 aa, Neisseria
MKTHRKTCSAVCFAFQTASKPAVSIRHPSEDIMSLKTRLTEDMKTAMRAKDQVSLGTIRLINAAVKQFEVDERTEADDAKITAILTKMVKQRKDGAKIYTEAGRQDLADKENAEIDVLHRYLPQMLSAGEIRTAVEAAVAETGAAGMADMGKVMVVLKTRLAGKADMGEVNKILKTVLTA

SEQ ID NO: 560 - protein, 165 aa, Neisseria
MRTHRKTCSAVCFAFQTASKPAVSIRHPSEDIMSLKIRLTEDMKTAMRAKDQVSLGTIRLINAAVKQFEVDERTEADDAKITAILTKMVKQRKDSAKIYTEAGRQDLADKENAEIEVLHRYLPQMLSAGEIRTEVEAAVAETGAAGMADMGKVMGLLKTRLAGKA

SEQ ID NO: 561 - protein, 218 aa, Neisseria
MLARRYFFNIQPGAVFTDKLLEQLMRFLQFLPEFLFALFRIFTHKSNRALKFARRHHIHINIMFFQQAVDIRHFRHHTHRTDDRKRSGNNFIRHTRHHIAAACRDLIDGDGQRNIAFAQTPKLRSRQTVTVNHAARTFQSEQNLIFRLGNQKHRRNLMTQGFYGVCIQIAVKIQHKKAGFLRFGRFLPALLQTLFLCFGFRLFLFLFFFFLMFCLFLA

SEQ ID NO: 562 - protein, 217 aa, Neisseria
  VARIANT (1)...(217): Xaa = Any Amino Acid
MLARCHFLNIQLRAVLADKLLEQLMRFLQFLSEFLFALFRIFTHKSNRALKFARRHHIHINIMFFQQAVDIRYFRHHTHRTDNRKRSGSNFIRHTRHHITAARXXXXXXXXXXXXXXXXXXXXXXXXXXXXXXXXXXXXXXXXXXXXXXXXXXXXXXXXXXXXXXXXXXXXXXQHKKAFXRFGRFLPTLLQTFFLCFGFRLFLFLFLFFLMLCLFPA

SEQ ID NO: 563 - protein, 218 aa, Neisseria
MLARCHFLNIQLRAVLADKLLEQLMRFLQFLSEFLFALFRIFTHKSNRALKFARRHHIHINIMFFQQAVDIRYFRYNTHRTDNRKRSGNNFIRHTRHHITTARRHLIDGDGQRNIAFAQTPKLRSRQTVTVNHAARTFQSKQNLIFRLGNQKHRRNLMTQGFYGVCIQIAVKIQHKKAGFLRFGRFLPTLLQTLFLCFGFRLFLFLFLFFLMFCLFPA

SEQ ID NO: 564 - protein, 218 aa, Neisseria
  VARIANT (1)...(218): Xaa = Any Amino Acid
MLARCHFLNIQLRAVLADKLLEQLMRFLQFLSEFLFALFRIFTHKSNRALKFARRHHIHINIMFFQQAVDIRYFRHHTHRTDNRKRSGSNFIRHTRHHITAARRHLIDGDGQRNIAFAQTXKLRSRQTVTVNHAARTFQSEQNLIFRLGNQKHRRNLMTQGFYGVCIQIAVKIQHKKAGFLRFGRFLPTLLQTLFLCFGFRLFLFLFLFFLMFCLFPA

SEQ ID NO: 565 - protein, 218 aa, Neisseria; identical to SEQ ID NO: 563

SEQ ID NO: 566 - protein, 105 aa, Neisseria
MPLTMLCSRTCGLFIIQSDRKSGGNAVPRPSPFLPWQAMQLDSYTFCPFVMMLLSAAEAAAQRQHKMKAVGSRVVFIGVSPNVLKPCFLILPLRGEKFFWPKSGI

SEQ ID NO: 567 - protein, 101 aa, Neisseria
  VARIANT (1)...(101): Xaa = Any Amino Acid
MPLTMLCSSTCGFFMMKSERXSGGNMVPRPSPFLPWQATQLDSYTFCPFVMMLLSAAEAAAQKQPKTRAVGSRVVFIGVSFMFETLLLILRSGXKIFLPNQ

SEQ ID NO: 568 - protein, 99 aa, Neisseria
MPLTMLCSSTCGFFMMKSERSGGNMVPRPSPFLPWQATQLDSYTFCPFVMMLLSAAEAAAQRQPKTRAVGSRVVFIGVSLMFETLLLILRSGKIFLPNR

SEQ ID NO: 569 - protein, 124 aa, Neisseria
MQYLIVKYSHQIFVTITILVFNIRFFLLWKNPEKPLVGFWKALPHLNDTMLLFTGLWLMKITHFSPFNAPWLGTKILLLFAYIALGMVMMRARPRSTKFYTVYLLAMCCIACIVYLAKTKVLPF

SEQ ID NO: 570 - protein, 94 aa, Neisseria
KIRKALAGFWKALPHLNDTMLLFTGLWLMKITHFSPFNAPWLGTKILLLLAYIALGMMMMRARPRSTKFYTVYLLAMCCVACIVYLAKTKVLPF

SEQ ID NO: 571 - protein, 124 aa, Neisseria
  VARIANT (1)...(124): Xaa = Any Amino Acid
MQYLIVKYSHQIFVTITILVFNIRVFXLWKNPEKPLAGFWKALPHLNDTMLLFTGLWLMKITHFSPFNAPWLGTKILLLLAYIALGMMMMRARPRSTKFYTVYLLAMCCLTCIVYLAKTKVLPF

SEQ ID NO: 572 - protein, 103 aa, Neisseria
MQQGQLVGRVARNKDMRNAGLHGQRIGNGYAARVFVDIDVFQTDIVNVRTATYGCQHIFGNKYAFFAILLPMDFYIAVCVEFDLGFSIQMQFQFFSEHGFRLV

SEQ ID NO: 573 - protein, 103 aa, Neisseria
MQQRQLVGRIACDEDMRNTGLHGQRVGNRYAARIFFDIDIFQTDIVNVRTAAHGCQHIFGNKYAFFAILLPMDFYIAVCIEFDLGFSIQMQFQFFAEHGVRLV

SEQ ID NO: 574 - protein, 103 aa, Neisseria
MQQGQLVGRVARNKDMRNTGLHSQRIGNGYAARIFFDIDVFQTDIVNVRTAAYGCQHIFGNKYAFFAILLPMDFYIAVCVEFGLGFSIQMQFQFFTEHGFRLV

SEQ ID NO: 575 - protein, 89 aa, Neisseria
LLAALVLAACSSTNTLPAGKTPADNIETADLSASVPTRPAEPEGKTLADYGGYPSALDAVKQNNDAAAAAYLENAGDSAMAENVRKEWL

SEQ ID NO: 576 - protein, 524 aa, Neisseria
MYLPSMKHSLPLLAALVLAACSSTNTLPAGKTPADNIETADLSASVPTRPAEPERKTLADYGGYPSALDAVKQKNDAAVAAYLENAGDSAMAENVRNEWLKSLGARRQWTLFAQEYAKLEPAGRAQEVECYADSSRNDYTRAAELVKNTGKLPSGCTKLLEQAAASGLLDGNDAWRRVRGLLAGRQTTDARNLAAALGSPFDGGTQGSREYALLNVIGKEARKSPNAAALLSEMESGLSLEQRSFAWGVLGHYQSQNLNVPAALDYYGKVADRRQLTDDQIEWYARAALRARRWDELASVISHMPEKLQKSPTWLYWLARSRAATGNTQEAEKLYKQAAATGRNFYAVLAGEELGRKIDTRNNVPDAGKNSVRRMAEDGAVKRALVLFQNSQSAGDAKMRRQAQAEWRFATRGFDEDKLLTAAQTAFDHGFYDMAVNSAERTDRKLNYTLRYISPFKDTVIRHAQNVNVDPAWVYGLIRQESRFVIGAQSRVGAQGLMQVMPATAREIAGKIGMDAAQLYTADG

SEQ ID NO: 577 - protein, 616 aa, Neisseria
  VARIANT (1)...(616): Xaa = Any Amino Acid
MYPPSLKHSLPLLVXLVLAACSXTNTLSADKTPADNIETADLSASVPTXPAEPEXKTXADYGGYPSALDAVKQKNDAAVAAYLENAGDSAMAENVRNEWLKSLGARRQWTLXAXEYAKLEPAXRAQEVECYADSSRNDYTRAAELVKNTGKLPSGCTKLLEQAAASGLLDGNDAWRRVRGLLAGRQTTDARNLAAALGSPFDGGTQGSREYALLNVIGKEARKSPNAAALLSEMESGLSLEQRSFAWGVLGHYQSQNLNVPAALDYXGKVADRRQLTDDQIEWYARAAXXXRXXXXXAXXXXXXXXKXXXXXXXXXXXARSRAATGNTQXAXKLYKQAAAXGXNFYAVLXGEELGRXIDTRNNVPDAGKXSVLRMAEDGAIKRALVLFRNSRTAGDAKMRRXAQAEWRFATRGFDEDKLLTAAQTAFDHGFYDMAVNSAERTDRKLNYTLRYISXXXDTVIRHAQNVNVDPAWVYGLIRQESRFVMGAQSRVGAQGLMQVMPATAREIAGKIGMDAAQLYTADGNIRMGTWYMADTKRRLQNNEVLATAGYNAGPGRARRWQADTPLEGAVYAETIPFSETRDYVKKVMANAAYYASLFGAPHIPLKQRMGIVPAR

SEQ ID NO: 578 - protein, 113 aa, Neisseria
MVERKLTGAHYGLRDWVMQRATAVIMLIYTVALLVVLFALPKEYPAWQAFFSQAWVKVFTQVSFIAVFLHAWVGIRDLWMDYIKPFGVRLFLQVATIVWLVGCLVYSVKVIWG

SEQ ID NO: 579 - protein, 113 aa, Neisseria
MVERKLTGAHYGLRDWVMQRATAVIMLIYTVALLVVLFSLPKEYSAWQAFFSQTWVKVFTQVSFIAVFLHAWVGIRDLWMDYIKPFGVRLFLQVATIVWLVGCLVYSVKVIWG

SEQ ID NO: 580 - protein, 113 aa, Neisseria
  VARIANT (1)...(113): Xaa = Any Amino Acid
MVERKLTGAHYGLRDWAMQRATAVIMLIYTVALLVVLFALPKEYSAWQAFFSQTWVKVFTQVSFIAVFLHAWVGIRDLWMDYXKPFGVRLFLQVATIVWLVGCLVYSIKVIWG

SEQ ID NO: 581 - protein, 337 aa, Neisseria
MLKQTTLLAACTAVAALLGGCATQQPAPVIAGNSGMQTVSSAPVYNPYGATPYNAAPAANDAPYVPPVQTAPVYSPPAYVPPSAPAVSGTYVPSYAPVDINAATHTIVRGDTVYNISKRYHISQDDFRAWNGMTDNTLSIGQIVKVKPAGYAAPKTAAVESRPAVPAAAQTPVKPAAQPPVQSAPQPAAPAAENKAVPAPAPAPQSPAASPSGTRSVGGIVWQRPTQGKVVADFGGGNKGVDIAGNAGQPVLAAADGKVVYAGSGLRGYGNLVIIQHNSSFLTAYGHNQKLLVGEGQQVKRGQQVALMGNTDASRTQLHFEVRQNGKPVNPNSYIAF

SEQ ID NO: 582 - protein, 509 aa, Neisseria
MAAADKQLGSDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLEDLRGRKGPQLLHVITKKGNGYKLAENDPVKYHAVANLPKESAAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCIPNMIVAAPSDENECRLLLSTCYQADAPAAVRYPRGTGTGVPVSDGMETVEIGKGIIRREGEKTAFIAFGSMVAPALAVAGKLNATVADMRFVKPIDEELIVRLARSHDRIVTLEENAEQGGAGSAVLEVLAKHGICKPVLLLGVADTVTGHGDPKKLLDDLGLSAEAVERRVRAWLSDRDAAN

SEQ ID NO: 583 - protein, 379 aa, Neisseria
MSRLWFFAVKNIIIRLIYLLPKETQMALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLLEDGKTPSSYEYNVNATRTVVNFSHACGVSVEGEIGVLGNLETGEAGEEDGVGAAGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLGKTIEAMKQICLDRYLAFGCEGQAGKIKPVSLEKMASRYAKGELNQIVK

SEQ ID NO: 584 - protein, 257 aa, Neisseria
  VARIANT (1)...(257): Xaa = Any Amino Acid
MSCLWFFAVKNIIIRLIYLLPKETQMALVSMRQLLDHAAEXSYGLPAFNVNNLXQMRAIMEAADQVDAPVIVQASAGARKYAGAPFLRHLILAAVEVFPHIPVVMHQDHGASPDVCQRSIQLGFSSVMMDGSLMEDGKTPSSYEYNVNATRTVVNFSHACGVSVEGEIGVLGNLETGDAGEEDGVGAVGKLSHDQMLTSVEDAVCFVKDTGVDALAIAVGTSHGAYKFTRPPTGDVLRIDRIKEIHQALPNTHIVMH

SEQ ID NO: 585 - protein, 379 aa, Neisseria
MSRLWFFAAKNIIIRLIYLLPKETQMALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLMEDGKTPSSYEYNVNATRTVVNFSHACGVSVEGEIGVLGNLETGEAGEEDGVGAVGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLSKTIEAMKQICLDRYLAFGCEGQAGKIKPVSLEKMANRYAKGELNQIVK

SEQ ID NO: 586 - protein, 271 aa, Neisseria
MLKPCLVYSACAAALPARTSSSRRCVPSGRCAYQYSSRADATPRRRHSGAVAIRCSSDSSGRFCQTIKAAILPSFSARKTCSDGETSADSNWRCVHADGLQTVSSAASAAQSDGEAGRMFMFVPSVPPVLWQSGRFCCGRRAVRRVPRQLRDSRRRGRARENRRRSAYRVCLRRADGFPVRTHCRCRLKRRTPRGGQCLPPYRLDNRSNGGGSACRTTHKTLRPYARPQRRVCSFAAAAARRRHRAWGCRLKACRTALPNLAPRRCRYAVR

SEQ ID NO: 587 - protein, 270 aa, Neisseria
  VARIANT (1)...(270): Xaa = Any Amino Acid
MLKPCAVYSACAAVLPARTSSSRRCVSSGRCVNQYSSRADAIPWRRHSGAVAIRCSSDSSGRFCQTIKAAIPXSFSARKTCSDGETSADSNWRCVHADGLQTASSAASSSQSAQTARRMFTGALSVRPVLWQSGRFCCGRRANRRVRHGRQDNRPWLPMRESRRQSAYPVCLRTAELLPARTRCLCRLKRRIPPAAGCLPPARPDNRSNGGSSAYRTMHKTLRPYERPRQGCSFAAAAARRRHRARVRRLRGYQTALPNPELHRCRYAVR

SEQ ID NO: 588 - protein, 269 aa, Neisseria
MLKPCAVYSACAAVLPARTSSSRRCVSSGRCVNQYSSRADAIPWRRHSGAVAIRCSSDSSGRFCQTIKAAIPPSFSARKTCSDGETSADSNWRCVHADGLQTASSAASAAQSATARRMFTGAPSVPPVLWQSRRFCCGRRAARRVPQRRRENRLQPPDGSRRRSAYRVCLRRADGFPARTHCRCRLKRRILPAAGCLPPDRPDNRSNGGGSACRTMHKTLRPYVRPQRQGCSFAAAAARRRHRARVRRLKEYQTALPNLAPRRCRYAVP

SEQ ID NO: 589 - protein, 228 aa, Neisseria
MLKPCAVYSACAAVLPARTSSSRRCVSSGRCVNQYSSRADAIPWRRHSGAVAIRCSSDSSGRFCQTIKAAIPPSFSARKTCSDGETSADSNWRCVHADGLQTASSAASSSQSAQTARRMFTGALSVRPVLWQSGRFCCGRRANRRVRHGRQDNRPWLPMRESRRQSAYPVCLRTAELLPARTRCLCRLKRRIPPAAGCLPPARPDNRSNGGSSAYRTMHKTLRPYERP

SEQ ID NO: 590 - protein, 213 aa, Neisseria
MTDFRQDFLKFSLAQNVLKFGEFTTKAGRRSPYFFNAGLFNDGASTLQLAKFYAQSIIESGIRFDMLFGPAYKGIILAAATAMMLAEKGVNVPFAYNRKEAKDRGEGGVLVGAPLKGRVLIIDDVISAGTSVRESIKLIEAEGATPAGVAIALDRMEKGTGKLSAVQEVEKQYGLPVAPIASLNDLFILLQNNPEFGQFLEPVRTYRRQYGVE

SEQ ID NO: 591 - protein, 213 aa, Neisseria
MTDFRQDFLKFSLAQNVLKFGEFTTKAGRRSPYFFNAGLFNDGLSTLQLAKFYAQSIIESGIRFDMLFGPAYKGIILAAATAMMLAEKGVNVPFAYNRKEAKDHGEGGVLVGAPLKGRVLIIDDVISAGTSVRESIKLIEAEGATPAGVAIALDRMEKGTGELSAVQEVEKQYGLPVAPIASLNDLFILLQNNPEFGQFLEPVRAYRRQYGVE

SEQ ID NO: 592 - protein, 213 aa, Neisseria; identical to SEQ ID NO: 591

SEQ ID NO: 593 - protein, 163 aa, Neisseria
MPSEPPAASDGIKPTHTEKTSCPPVSVRTAKPASGSKKPSSTSPKASSSAKNAKGCLKPKTIWQARKNLYSTIGPKLFRDVKLVHRIGTHAISKKQMSRDEIADILNGGTTLHDTPPATAAAAPAAAPQVSVPPARQEGLNWTIATLFALIVLIMQLSYLFIL

SEQ ID NO: 594 - protein, 170 aa, Neisseria
  VARIANT (1)...(170): Xaa = Any Amino Acid
MPSEPPYASDGIKPDTHEEIPCPPVSAPTAKPVSGSKKPNSMSPXXXXXXXXXXXXXXXXXXXXXXXXXXXXXXXXXXXPEAVSDVKLVHRIGTRAIGKKQISRDEIAGILNGGTTQPDIPPATAATPAAAPQVTVPPAAPARQDGFNWTIATLFALIVLIMQLSYLVIL

SEQ ID NO: 595 - protein, 165 aa, Neisseria
  VARIANT (1)...(165): Xaa = Any Amino Acid
MPSEPPYASDGIKPDTHEEIPCPPVSAPTAKPVSGSKKPNSMSPKASSSAKNAKECLKPKTIWQARKNPYSTIXPEAVSDVKLVHRIGTSAIGKKQISRDEIAGILNGGTTQPDIPPATAATPAAAPQVTVPPAAPARQDGFNWTIATLFALIVLIMQLSYLVIL

SEQ ID NO: 596 - protein, 436 aa, Neisseria
MNAPDSFVAHFREAAPYIRQMRGTTLVAGIDGRLLEGGTLNKLAADIGLLSQLGIRLVLIHGAYHFLDRLAAAQGRTPHYCRGLRVTDETSLGQAQQFAGTVRSRFEAALCGSVSGFARAPSVPLVSGNFLTARPMGVIDGTDMEYAGVIRKTDTAALRFQLDAGNIVWMPPLGHSYGGKTFNLDMVQAAASVAVSLQAEKLVYLTLSDGISRPDGTLAETLSAQEAQSLAEHAASETRRLISSAVAALEGGVHRVQILNGAADGSLLQELFTRNGIGTSIAKEAFVSIRQAHSGDIPHIAALIRPLEEQGVLLHRSREYLENHISEFSILEHDGDLYGCAALKTFAEADCGEIACLAVSPQAQDGGYGERLLAHIIDKARGIGISRLFALSTNTGEWFAERGFQTASEDELPETRRKDYRSNGRNPHILVRRLHR

SEQ ID NO: 597 - protein, 412 aa, Neisseria
  VARIANT (1)...(412): Xaa = Any Amino Acid
MSAPDLFVAHFREAVPYIRQMRGKTLVAGIDDRLLEGDTLNKLAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFYLDMLQTAASAAVSLQAEKLVYLTLSDGISRPDGTLAETLSAQEAQSLAEHAGGQTRRLISSAELFTRNGIGTSIAKEAFVSIRQAHXXDIPHIAALIRPLEEQGILLHRXREYLENHISEFSILEHDGNLYGCAALKTFAEADCGEIACLAVSPQXQDGGYGERXLAHIIDKARGIGISRLFALSTNTGEWFAERGFQTASEDELPETRRKDYRSNGRNSHILVRRLHR

SEQ ID NO: 598 - protein, 436 aa, Neisseria
MIVPDLFVAHFREAAPYIRQMRGKTLVAGIDDRLLEGDTLNKFAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFHLDMLQTAASVAVSLQAEKLVYLTLSDGISRPDGTLAVTLSAQEAQSLAEHAGGETRRLISSAVAALEGGVHRVQILNGAADGSLLQELFTRNGIGTSIAKEAFVSIRQAHSGDIPHIAALIRPLEEQGILLHRSREYLENHISEFSILEHDGNLYGCAALKTFAEADCGEIACLAVSPQAQDGGYGERLLAHIIDKARGIGISRLFALSTNTGEWFAERGFQTASEDELPETRRKDYRSNGRNSHILVRRLHR

SEQ ID NO: 599 - protein, 154 aa, Neisseria
MSSPKHIGLQGGSNGGLITAAAFVREPQSIGALVCEVPLTDMIRYPLLSAGSSWTDEYGNPQKYEACKRRLGELSPYHNLSDGIDYPPALITTSLSDDRVHPAHALKFYAKLRETSPQSWLYSPDGGGHTGNGTQRESADKLACVLLFLKEFLG

SEQ ID NO: 600 - protein, 154 aa, Neisseria
ISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSAQSWLYSPDGGGHTGNGTQRESADELACVLLFLKEFLG

SEQ ID NO: 601 - protein, 154 aa, Neisseria
ISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSPQSWLYSPDGGGHTGNGTQREAADELACVLLFLKEFLG

SEQ ID NO: 602 - protein, 671 aa, Neisseria
MKSYPDPYRHFENLDSAETQNFAAEANAETRARFLNNDKARALSDGILNQMQDTRQIPFCQEHRARMYHFHQNAEYPKGVYRMCTAATYRSGYPEWKILFSVADFDELLGDDVYLGGVSHLVEQPNRALLTLNKSGGDTAYTLEVDLEAGELVEGGFHFPAGKNHVSWRDENSVWVCPAWDERQLTESGYPREVWLVERGKSFEESLPAYQIDKGAMMVNAWRYLDPQGSPIDLIEASDGFYTKTYLQVSSEGGAKPLNLPNDCDVVGYLAGHLLLTLRKDWHRANQSYPSGALVAVKLNRGELGAAQLLFAPDETQALESVETTKRFVVASLLENVQGRLKAWRFADSKWQEAELPHLPSGALEMTDQPWGGDVVYLAASDFTTPLTLFALDLNVMELTVMRLQPQQFVSDGIEVRQFWAVSSDGERIPYFHVGKNAAPDTPTLVYAYGGFGIPELPHYLGSVGKYWLEEGNAFVLANIRGGGEFGPRWHQAAQGISKHKSVDDLLAVVRDLSERGMSSPKHIGLQGGSNGGLITAAAFVREPQSIGALVCEVPLTDMIRYPLLSAGSSWTDEYGNPQKYEACKRRLGELSPYHNLSDGIDYPPALITTSLSDDRVHPAHALKFYAKLRETSPQSWLYSPDGGGHTGNGTQRESADKLACVLLFLKEFLG

SEQ ID NO: 603 - protein, 671 aa, Neisseria
MKSYPDPYRHFENLDSAETQNFAAEANAETRARFLENDKARALSDGILAQLQDTRQIPFCQEHRARMYHFHQDAEYPKGVYRVCTAATYRSGYPEWKILFSVADFDELLGDDVYLGGVSHLVEQPNRALLTLSKLGSDTAYTLEVDLEAGELVEGGFHFPAGKNHVSWRDENSVWVCPAWNERQLTQSGYPREVWLVERGKSFEESLPVYQIGEDGMMVNAWRYLDPQGSPIDLIEASDGFYTKTYLRVSAEGEAKPLNLPNDCDVVGYLAGHLLLTLRKDWNRANQSYPSGALVAVKLNRGELGAAQLLFAPDETQALESVETTKRFVVASLLENVQGRLKAWRFADGKWQEVELPRLPSGALEMTDQPWGGDVVYLAASDFTTPLTLFALDLNVMELTVMRRQPQQFDSDGINVQQFWTTSADGERIPYFHVGKNAAPDMPTLVYAYGGFGIPELPHYLGSIGKYWLEEGNAFVLANIRGGGEFGPRWHQAAQGISKHKSVDDLLAVVRDLSERGISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSAQSWLYSPDGGGHTGNGTQRESADELACVLLFLKEFLG

SEQ ID NO: 604 - protein, 671 aa, Neisseria
MKSYPDPYRHFENLDSAETQNFAAEANAETRARFLNNDKARALSDGILAQLQDTRQIPFCQEHRARMYHFHQDAEYPKGVYRVCTAATYRSGYPEWKILFSVADFDELLGDDVYLGGVSHLVEQPNRALLTLSKSGGDTAYTLEVDLEAGELVEGGFHFPAGKNHVSWRDENSVWVCPAWDERQLTESGYPREVWLVERGKSFEESLPVYQIAEDGMMVNAWRYLDPQGSPIDLIEASDGFYTKTYLQVSAEGEAKPLNLPNDCDVVGYLAGHLLLTLRKDWHRANQSYPSGALVAVKLNRGELGAAQLLFAPNETQALESVETTKRFVVASLLENVQGRLKAWRFTDGKWQETELPRLPSGALEMTDQPWGGDVVYLAASDFTTPLTLFALDLNVMELTVMRRQPQQFDSDGINVQQFWTTSADGERIPYFHVGKNAAPDMPTLVYAYGGFGIPELPHYLGSIGKYWLEEGNAFVLANIRGGGEFGPRWHQAAQGISKHKSVDDLLAVVSDLSERGISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSPQSWLYSPDGGGHTGNGTQREAADELACVLLFLKEFLG

SEQ ID NO: 605 - protein, 201 aa, Neisseria
MTMICLRFQAFVPHTSALSNTSTAAGPSCPMAAVRSMMKIQPGFFSLMYSKETGCPCPSLRKDSSTGGRPMSPCIQLANRDCVPKADTLLPVTDSTSPRPLPLAASRFWANSASICAFNSATRASLPKIRDRVSICFSPLVRILPLSTVKSMVVAFFANCSYASAPGPPVMTNCGLWRCRDSQSGSNSVPTVAALSNAGCK

SEQ ID NO: 606 - protein, 201 aa, Neisseria
  VARIANT (1)...(201): Xaa = Any Amino Acid
MTMICLRFQAFVPRTSALSXTSTAAGXSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTSXGLXRCRASXSGSNSVPTVAALSNAGCK

SEQ ID NO: 607 - protein, 198 aa, Neisseria
MTMICLRFQAFVPRTSALSNTSTAAGPSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTSGLRCRASSGSNSVPTVAALSNAGCK

SEQ ID NO: 608 - protein, 173 aa, Neisseria
MTMICLRFQAFVPRTSALSNTSTAAGPSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTS

SEQ ID NO: 609 - protein, 173 aa, Neisseria; identical to SEQ ID NO: 608

SEQ ID NO: 610 - protein, 128 aa, Neisseria
MVVSNQNIYAVGPSALFHIRRQKSVMPPERFVEPSRVAVAAKVHRGLDGAARFDEGERVFQPQAAQASGDGFAGLRFEIAFQVAFVQPDAAGDFGDGQRAGEFAVQNIGGFVYAPAAVAVVVAAEGEA

SEQ ID NO: 611 - protein, 129 aa, Neisseria
MVVSNQNIYAAGPSALLHIRRQKSVMPSERFVEPSRVAVAAKVHGGLDGAAGFDEGERVFQPQAAQASGDGFAGLRFEIAFQVAFVQSDAAGDFGDGQRTGEFVLQDVGGFVYAPTAVTVVVAAEGEAQ

SEQ ID NO: 612 - protein, 129 aa, Neisseria; identical to SEQ ID NO: 611

SEQ ID NO: 613 - protein, 89 aa, Neisseria
MLPDQSVEFLPQVVVFDGLFGGGFPAVALPTVYPVFHAVFDVLRVGADDDGAAAFERFQPFDNGGQLHAVVGGLRFAAEKFFFAAAVAH

SEQ ID NO: 614 - protein, 89 aa, Neisseria
  VARIANT (1)...(89): Xaa = Any Amino Acid
MPSDXSVEFFPEVVVFDGLFGGGFPAVALPTVYPVFHAIFDVLRVGADDDGAAAFERFQSFDDGSQFHAVVGGLRFAAEKFFFVATVAH

SEQ ID NO: 615 - protein, 89 aa, Neisseria
VPSDQRVEFFPQVVVFDGLFGGGFPAVALPTVYPVFHAVFDVLRVGADDDGAAAFERFQSFDDGGQFHTVVGGLRFAAEKFFFVAAVAH

SEQ ID NO: 616 - protein, 186 aa, Neisseria
MSAMLRPTSSPPRRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARYNVKGDAPLPKTVWTSRRLPVSCNAFSSMSITVTSLLVMAARFCATVEPTCPLPKMRIFTVWVAG

SEQ ID NO: 617 - protein, 186 aa, Neisseria
  VARIANT (1)...(186): Xaa = Any Amino Acid
MSAMLRPTSXPXXRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARSNVKGDAPLPKTVWTSRRLPVSCNAFSSMSITVTSLLGMAARFCATVEPTCPLPKMRIFTVWVAE

SEQ ID NO: 618 - protein, 186 aa, Neisseria
MSAMLRPTSSPPRRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARSNVKGDAPLPKTVWTSRRLPVSCNAFSSMSITVTSLLGMAARFCATVEPTCPLPKMRIFTVWVAE

SEQ ID NO: 619 - protein, 309 aa, Neisseria
MVIIQARRGGLLVGRSIADIAQDLPDGADCQICAVYRNNRLIVPAPQTVIIEGDEILFAAAAENIGAVIPELRPKETSTRRIMIAGGGNICYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 620 - protein, 312 aa, Neisseria
  VARIANT (1)...(312): Xaa = Any Amino Acid
MVIIQARXXGXLVGRSIADIAQDLPDGADCQICAVYRNNRLIVPAPQTVIIEGDEILFAAAAENIGAVIPELRPKETQRNQPXXIMIXGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 621 - protein, 309 aa, Neisseria
MVIIQARRGGLLVGRSIADIAQDLPDGADCQICAVYRNNRLIVPAPQTVIIEGDEILFAAAAENIGAVIPELRPKETSTRRIMIAGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 622 - protein, 150 aa, Neisseria
MLDKGEELPVDFTNRLIYYVGPVDPVGDEVVGPAGPTTATRMDKFTRQMLKQTGLLGMIGKSERGAATCEAIADNKAVYLMAVGGAAYLVAKAIKSSKVLAFPELGMEAVYEFEVKDMPVTVAVDSKGESIHATAPRKWQAKIGIIPVES

SEQ ID NO: 623 - protein, 150 aa, Neisseria
MLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 624 - protein, 150 aa, Neisseria
MLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 625 - protein, 139 aa, Neisseria
MRAQAFDQPFGQLLFGQAEHFAPVDGFRVQDIDLDGHQRLFRTAFAVFRNPVCRRTGFCRIGVFPALNLCGFKFGTVFFGIEPDSPPRFDVFFRNRHLQGSLRVEPVFLKDDHRVGFDFLAAIGNGAVVFFLPFLQIRL

SEQ ID NO: 626 - protein, 139 aa, Neisseria
MRAQAFDQPFGQLLFGQAEHFAPVDGFRVQDIDLDGHQRFFRIVFPVFRNRRLIRAGFCLVGVFPAFNLSGFKFDTVFFGIKPDSPPRFDVFFRNRHLQGSLRVEPVFLKDDHRVGFDFLAAIGNGGIVFLLPFFQIRL

SEQ ID NO: 627 - protein, 139 aa, Neisseria
MRAQAFDQPFGQLLFGQAEHFAPVDGFRVQNIDLDGHQRFFRTAFAVFRNPVCRRTRFCRIGVFPAFNLSGFKFGTVFFGIKPDSPPRFDVFFRNRHLQGSLRVEPVFLKDDHRVGFDFLAAIGNGGIVFLLPFFQIRL

SEQ ID NO: 628 - protein, 127 aa, Neisseria
MGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVED

SEQ ID NO: 629 - protein, 130 aa, Neisseria
  VARIANT (1)...(130): Xaa = Any Amino Acid
MGAGWCPPGILGIGIGGXAEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDGPI

SEQ ID NO: 630 - protein, 129 aa, Neisseria
MGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWP

SEQ ID NO: 631 - protein, 506 aa, Neisseria
MTVIKQEDFIQSICDAFQFISYYHPKDYIDALYKAWQKEENPAAKDAMTQILVNSRMCAENNRPICQDTGIATVFLKVGMDVQWDADMSVEKMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDPDLTYSPDNGKRVDVDKLTKEEVASWKTGDVLLLNGKILTGRDAAHKRLVNMLDKGEELPVDFTNRLIYYVGPVDPVGDEVVGPAGPTTATRMDKFTRQMLKQTGLLGMIGKSERGAATCEAIADNKAVYLMAVGGAAYLVAKAIKSSKVLAFPELGMEAVYEFEVKDMPVTVAVDSKGESIHATAPRKWQAKIGIIPVES

SEQ ID NO: 632 - protein, 507 aa, Neisseria
MTVIKQEDFIQSICDAFQFISYYHPKDYIDALYKAWQKEENPAAKDAMTQILVNSRMCAENNRPICQDTGIATVFLKVGMNVQWDADMSVEEMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 633 - protein, 507 aa, Neisseria
MTVIKQEDFIQSICDAFQFISYYHPKDYIDALYKAWQKEENPAAKDAMTQILVNSRMCAENNRPICQDTGIATVFLKVGMDVQWDADMSVEEMVNEGVRRAYTWEGNTLRASVLADPAGKRQNTKDNTPAVIHMSIVPGDKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 634 - protein, 119 aa, Neisseria
MALVAEETEISAPCFKGCEPTGDSRLLSTTKSAPMPCANSAKASKSATSPKGLDGVSKNSSLVLALTAAFHSFISVGDTRLTPMPNLVTMLLIKPTVVPNRLRLETTWSPACRKVKNAA

SEQ ID NO: 635 - protein, 119 aa, Neisseria; identical to SEQ ID NO: 634

SEQ ID NO: 636 - protein, 117 aa, Neisseria
MALVAEETEISAPCFKGEPTGDSRLLSTTKSAPMPCANSAKASKSATSPKGLDGVSKNSSLVLALTAAFHSFISVGDTLTSMPNLVTMLLIKPTVVPNRLRLEITWSPACKKVKNAA

SEQ ID NO: 637 - protein, 128 aa, Neisseria
MCMPYAIRVSDGICRIFPPMPSETRNQRASACFKSSIKSPTYSKPTDRRTSPGRIPAASFSSGCILPCVVVHGLVMVERTSPRLAVREKSSTTFHAAAWSATSKPMTMPPPFCCLRISSACGWSGNPV

SEQ ID NO: 638 - protein, 128 aa, Neisseria
  VARIANT (1)...(128): Xaa = Any Amino Acid
MCMPYKIRVSDGICCPMPSETRNQRASACFKSSIKSPTYSKPTDRRTNPGRMLAASFSSGCILPCVVVHGWVMVERTSPRLAVREKSSTPSTTFHAASXSATSKPMTMPPPFCCLRISAAXGWSDNPV

SEQ ID NO: 639 - protein, 130 aa, Neisseria
  VARIANT (1)...(130): Xaa = Any Amino Acid
TCMSYKIRVSDGICGVFPPMPSEXRNQRASACFKSSIKSPTYSKPTDRRTNPGRMLAASFSSGCILPCVVVHGWVMVERTSPRLAVREKSSTPSTTFHAAAWSATSKPMTMPPPFCCLRISSAGWSGNPV

SEQ ID NO: 640 - protein, 137 aa, Neisseria
MPPYFITLLTMENTKSAAKTPTTIQPASIPSAFAASKAFFAVSGNAAFACAAKASGAAVTTASFAPYLRQVLINFMIFSFTKFLKKCVCGLCEGFRDRLPGLLNLIFFFVESENYKFPAYLFQCRAKSVFIAVIFTG

SEQ ID NO: 641 - protein, 136 aa, Neisseria
MPSYFITLLTMENTKSAAKMPTTIQPASIPSAFAASKAFFAVSGNVAFACAAKARGAAVTTASFAPYLRQVLINFMIFSFKKCLAVMDGAFFRRPPNIRKSVFQKSEYDKFVLVADFFQTCVNRFFEVVEIIGIGD

SEQ ID NO: 642 - protein, 136 aa, Neisseria
MPSYFITLLTMEKTKSAAKTPTTIQPASIPSAFAASKAFFAVSGNVAFACAAKARGAAVTTASFAPYLRQVLINFMIFSFKKCLAVMDGAFFRRPPNIRKSVFQKSEYDKFVLVADFFQTCVNRFFEVVEIIGIGD

SEQ ID NO: 643 - protein, 275 aa, Neisseria
MWDNAEAMERLTRWLLVMMAMLLAASGLVWFYNSNHLPVKQVSLKGNLVYSDKKALGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWNVVLDNGITVRLGRENEMKRLRLFTEAWQHLLRKNKNRLSYVDMRYKDGFSVPHAPDGLPEKESEEYWEQVWDILRPGVGNGSTQISISYKGRRTMEQQ

SEQ ID NO: 644 - protein, 242 aa, Neisseria
MWDNAEAMERLTRWLLVMMAMLLAASGLVWFYNSNHLPVKQVSLKGNLVYSDKKTLGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWIVVLDNGITVRLGRENEMKRLRLFTEAWQHLLRKNKNRLSYVDMRYKDGFSVRYASDGLPEKESEE

SEQ ID NO: 645 - protein, 242 aa, Neisseria
MWDNAEAMERLTRWLLVMMAMLLAASGLVWFYNSNHLPVKQVSLKGNLVYSDKKALGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWIVVLDNGITVRLGRENEMKRLRLFTEAWQHLLRKNKNRLSYVDMRYKDGFSVRYAPDGLPEKESEE

SEQ ID NO: 646 - protein, 452 aa, Neisseria
MKPLDLNFICQALKLPMPSENKPVSRIVTDSRDIREGDVFFALAGGRFDAHDFVGGVLSAGAAAVVVSREDCAALGGALKVDDTLAALQTLAKAWRDNVNPFVFGITGSGGKTTVKEMLAAVLRRRFGDDAVSATAGNFNNHIGLPLTLLKLNEKHRYAVIEMGMNHFGELAVLTQIAKPDAALVNNALRAHVGCGFDGVGDIAKAKSEIYAGLCSDGMALIPQEDANMAVFKTATFNLNTCTFGVDSGDVRAENIVLKPLSCEFDLVCGDERTAVVLPVPGRHNVHNAAAAAALALAAGLSLNDVAEGLQGFSNIKGRLNVKAGIKGATLIDDTYNANPDSMKAAVDVLARMPAPRIFVMGDMGELGEDEAAAMHAEVGAYARDQGIEAAYFVGDNSVEAAEKFGADGLWFAAKDPLIQVLSHDLPERATVLVKGSRFMQMEEVVEALEDK

SEQ ID NO: 647 - protein, 455 aa, Neisseria
  VARIANT (1)...(455): Xaa = Any Amino Acid
MKPLDLNFICQALKLPMPSESKPVSRIVTDSRDIRAGDVFFALAGERFDAHDFVEDVLAAGAAAVVVSREDCAAMDGALKVDDTLAALQTLAKAWRENVNPFVFGITGSGGKTTVKEMLAAVLRRRFGDDAVLATAGNFNNHIGLPLTLLKLNEKHRYAVIEMGMNHFGELAVLTXIAKPNAALVNNAMRAHVGCGFDGVGDIAKAKSEIYQGLCSDGIALIPQEDANMAVFKTATLNLNTRTFGIDSGDVHAENIVLKPLSCEFDLVCGDERAAVVLPVPGRHNVHNAAAAAALALAAGLSLNDVAEGLKGFSNIKGRLNVKSGIKGATLIDDTYNANPDSMKAAIDVLARMPAPRIFVMGDMGELGELGEDEAAAMHAEVGAYARDQGIEAAYFVGDNSVEAAEKFGADGLWFAAKDPLIQVLRHDLPERATVLVKGSRFMQMEEVVEALEDK

SEQ ID NO: 648 - protein, 452 aa, Neisseria
MKPLDLNFICQALKLPMPSESKPVSRIVTDSRDIRAGDVFFALAGGRFDAHDFVEDVLAAGAAAVVVSREDCVAMDGALKVDDTLTALQMLAKAWRENVNPFVFGITGSGGKTTVKEMLAAVLRRRFGDNAVLATAGNFNNHIGLPLTLLKLNEKHRYAVIEMGMNHFGELAVLTQIAKPDAALVNNAMRAHVGCGFDGVGDIAKAKSEIYQGLCSDGMALIPQEDANMAVFKTATLNLNTRTFGIDSGDVHAENIVLKPLSCEFDLVCGNECAAVVLPVPGRHNVHNAAAAAALSLAAGLSLNDVAEGLKGFSNIKGRLNVKSGIKGATLIDDTYNANPDSMKAAVDVLARMPAPRIFVMGDMGELGEDEAAAMHAEVGAYARDQGIEAAYFVGDNSVEAAEKFGADGLWFAAKDPLIQVLRHDLPERATVLVKGSRFMQMEEVVEALEDK

SEQ ID NO: 649 - protein, 247 aa, Neisseria
MWLLKLPAVAETASSPKRRRNTAASISFTVVLPPEPVMPNTNGFTLSRHAFANVCNAASVSSTFNAPPKAAQSSRETTTAAAPADNTPPTKSCASNRPPANAKNTSPSRISRLSVTMRDTGLFSDGIGSLRAWQMKFRSSGFIFAFVNIRAADTSVAADFFIACFAVVKHRLFSHSHSAFFLYVSFFRRIFSRFAFSRIPRRGVVGLSVDKGKVIAFARHIGDIPPKIIAVIGQLVGFDTRPTAESA

SEQ ID NO: 650 - protein, 247 aa, Neisseria
  VARIANT (1)...(247): Xaa = Any Amino Acid
MXLLKLPAVANTASSPKRRRNTAASISFTVVLPPEPVMPNTNGFTFSRHAFASVCNAASVSSTFNAPSIAAQSSRETTTAAAPAANTSSTKSCASNRSPANAKNTSPARMSRLSVTMRDTGLLSDGIGSLRAWQMKFRSSGFIFTFVNIRAADTSVAADFFIACFAVVKHRLFSHSHSXFFLYVSFFRRIFSRFAFSRIPRRGVVGQSVDKGKVIAFALHIGNIPPKIIAVIGQLVGFDTRPTAESA

SEQ ID NO: 651 - protein, 247 aa, Neisseria
MWLLKLPAVAKTALSPKRRRNTAANISFTVVLPPEPVIPNTNGFTFSRHAFANICNAVSVSSTFNAPSIATQSSRETTTAAAPAANTSSTKSCASNRPPANAKNTSPARMSRLSVTMRDTGLLSDGIGSLRAWQMKFRSSGFIFTFVNIRAADTSVAADFFIACFAVVKHRLFSHSHSAFFLYVSFFRRIFSRFAFSRIPRRGVVGQSVDKGKVIAFALHIGNIPPKIIAVIGQLVGFDTRPTAESA

SEQ ID NO: 652 - protein, 231 aa, Neisseria
MKQSARIKNMDQTLKNTLGICALLAFCFGAAIASGYHLEYEYGYRYSAVGALASVVFLLLLARGFPRVSSVVLLIYVGTTALYLPVGWLYGAPSYQIVGSILESNPAEAREFVGNLPGSLYFVQALFFIFGLTVWKYCVSVGVFADVKNYKRRSKIWLTILLTLILSCAVMEKIAGDKDWREPDAGLLLNIFDLYYDLAFRAGTICRQARPHFGSSKKSVNMAYPPTCAQV

SEQ ID NO: 653 - protein, 231 aa, Neisseria
  VARIANT (1)...(231): Xaa = Any Amino Acid
MKQSARIKXMNQTLLYTLGICALLTFXXXXXXXXXYHPEYEYGYRYSAVGALASVVFLLLLARGFPRVSSVVLLIYVGTTALYLPVGWLYGAPSYQIVGSILESNPAEAREFVGNLPGSLYFVQALFFIFGLTVWKYCVSGGVFADVKNYKRRSKIWLTILLTLILSCAVMDKIASDKDLREPDAGLLLNIFDLYYDLAXRAGTICRQARPHFGSSKKSVNMAYPSCCAQV

SEQ ID NO: 654 - protein, 231 aa, Neisseria
  VARIANT (1)...(231): Xaa = Any Amino Acid
MKQSARIKNMDQTLKNTLGICALLAFCFGAAIASGYHLEYEYGYRYSAVGALASVVFLLLLARGFPRVSSVVLLIYVGTTALYLPVGWLYGAPSYQIVGSILESNPAEAREFVGNLPGSLYFVQALFFIFGLTVWRYCVSGGVFADVKNYKRRSKIWLTILLTLILSCAVMDKIASDKDLREPDAGLLLNIFDLYYDLASXAGTICRQARPHFGSSKKSVNMAYPSCCAQV

SEQ ID NO: 655 - protein, 94 aa, Neisseria
MGKGQDFTPLRDALKDKAKGVFLIGVDAPQIRRDLDGCGLNLTDCVTLEEAVQTAYAQAEAGDIVLLSPACASFDMFKGYAHRSEVFIEAFKAL

SEQ ID NO: 656 - protein, 94 aa, Neisseria
MGKGQDFTPLRDALVGKAKGVFLIGVDAPQIRRDLDGCGLNMTDCATLGEAVQTAYAQAEAGDIVLLSPACASFDMFKGYAHRSEVFIEAFKAL

SEQ ID NO: 657 - protein, 94 aa, Neisseria
MGKGQDFTPLRDALAGKAKGVFLIGVDAPQIRRDLDGCDLNMTDCATLEEAVQKAYAQAEAGDIVLLSPACASFDMFKGYAHRSEVFIGAFKAL

SEQ ID NO: 658 - protein, 396 aa, Neisseria
MVVLMTAFGLLMIYSASVYLASKEGGDQFFYLTRQAGFVVAGLIASGFLWFLCRMRTWRRLVPWIFALSGLLLVAVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVITVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRQKMRGYRVE

SEQ ID NO: 659 - protein, 396 aa, Neisseria
  VARIANT (1)...(396): Xaa = Any Amino Acid
MVVLMTAFSLLMIYSASVYLASKEGGDQFFYLTRQAGFVVAGLIASGLLWFLCRMRTWRRLVPWIFALSGLLLVVVLIAGREINGATRWIPLGPLNFQPTELFKLAVILYLASLFTRREEVLRSMESLGWQSIWRGTANLIMSATNPQXRRETLEMYGRXRAIILPIMLVAFGLVLIMVQPDFGSFVVITVIAVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGXQSFFNIGVNIGALPXKGLTXPXMSXGGSSVFFMLISMMLLXRIDYENRRKMRGYRVE

SEQ ID NO: 660 - protein, 396 aa, Neisseria
MVVLMTAFSLLMIYSASVYLASKEGGDQFFYLTRQAGFVVAGLIASGLLWFLCRMRTWRRLVPWIFALSGLLLVVVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVIAVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRRKMRGYRVE

SEQ ID NO: 661 - protein, 355 aa, Neisseria
MGGKTFMLMAGGTGGHIFPALAVADSLRVRGHHVIWLGSKDSMEERIVPQYGIRLETLAIKGIRGNGIKRKLMLPFTLYKTVREAQRIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPEEVRPQMYHQSGRNKLGNLQADYDALGVKAECVEFITDMVSAYRDADLVICRAGALTIAELTAAGLGALLVPYPHAVDDHQTANARFMVQAEAGLLLPQTQLTAEKLAEILGSLNREKCLKWAENARTLALPHSADDVAEAAIACAA

SEQ ID NO: 662 - protein, 335 aa, Neisseria
  VARIANT (1)...(335): Xaa = Any Amino Acid
MGGKTFMLXXGGTGGHIFPALAVADSLRARGHHVIWLGSKDSMEERIVPQYGIRLETLAIKGVRGNGIKRKLMLPVTLYQTVREAQRIIRKHRVECVIGFGGFVTFPGGLAAKLLXVPIVIHEQNAVAGLSNRHLSRWAKRVLYAFPKAFSHEGGLVGNPVRADISNLPVPAERFQGREGRLKILVVGGSLGADVLNKTVPHALALLPDNARPHMYHQSGRGKLGILQAXXXXXXXXXXXXXXXXXXXXXXAGLGALLVPYPHAVDDHQTANARFMVQAEAGLLLPQTQLTAEKLAEILGGLNREKCLKWAENARTLALPHSADDVAEAAIACAA

SEQ ID NO: 663 - protein, 355 aa, Neisseria
MGGKTFMLMAGGTGGHIFPALAVADSLRARGHHVIWLGSKDSMEERIVPQYDILLETLAIKGVRGNGIKRKLMLPFTLYQTVREAQQIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPDNARPQMYHQSGRGKLGSLQADYDALGVQAECVEFITDMVSAYRDADLVICRAGALTIAELTAAGLGALLVPYPHAVDDHQTANARFMVQAEAGLLLPQTQLTAEKLAEILGGLNREKCLKWAENARTLALPHSADDVAEAAIACAA

SEQ ID NO: 664 - protein, 376 aa, Neisseria
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAVIAGLALFYLAANSANNILIVPFFKQIALPLGVVGFLVLSYLTIVGTSNAVNLTDGLDGLAAFPFVLVAAGLAIFAYVSGHYQFSQYLQLPYVAGANEVAIFCTAMCGACLGFLWFNAYPAQVFMGDVGALALGAALGTVAVIVRQEFVLVIMGGLFVVEAVSVMLHVGWYKKTKKRIFLTAPIHHHYQLRCWKETQVVVRFWIITIVVVLIGLSTLKIRGNYAVRTPFRRHLNAQ

SEQ ID NO: 665 - protein, 376 aa, Neisseria
  VARIANT (1)...(376): Xaa = Any Amino Acid
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAVIAGLALFYLAANSANNILIVPFFKQIALPLGVVGFLVLSYLTIVGTSNAVNLTDGLDGLATFPVVLVAAGLAIFAYASGHSQFAQYLQLPYVAGANEVVIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIRXTYAVXTSFRRHLNAQ

SEQ ID NO: 666 - protein, 374 aa, Neisseria
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAIIAGLALFYLAANSANNILIVPFFKQIALPLGVVGFLVLSYLTIVGTSNAVNLTDGLDGLATFPVVLVAAGLAIFAYASGHSQFAQYLQLPYVAGANEVVIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIRTYAVTPFRRHLNAQ

SEQ ID NO: 667 - protein, 149 aa, Neisseria
MPPKITKSGFCKPAIAAAVAPTFVPLLSSMNTTPFFSPIFSTRCGKPWKVLTCSSNASRGKPTASHKATAAITLAALCKPCSGMSCVEIKSSLPCFKQPVPRSNQKSASCSKENRFTSRPARFMARQNTSSAFKTCTPSPRKISALVCA

SEQ ID NO: 668 - protein, 149 aa, Neisseria
  VARIANT (1)...(149): Xaa = Any Amino Acid
MPPKITXSGFCKPAIAAAVAPTFVPLLSSINTTPFFSPIFSTRCGRPWKVLTCSSNASRDKPMASHKATAAMTLAALCXPCNGMSCVTIKSSLPCFRRPVSRSNQKSASCSNENHFTSRPARFIARQNASSAFKTCTPSPRKILALVCA

SEQ ID NO: 669 - protein, 148 aa, Neisseria
MPPKITKSGFCKPAIAAAVAPTFVPLLSSMNTTPFFSPIFSTRCGRPKVLTCSSNASRGKPTASHKATAAITLVALCKPCSGISCVAIKSSLPCFRRPVSRSNQKSASYSNENHFTSRPARFIARQNASSAFKTCTPSPRKILALVCA

SEQ ID NO: 670 - protein, 118 aa, Neisseria
  VARIANT (1)...(118): Xaa = Any Amino Acid
MRVVEQIVVAVEMVFGNVHHRRRSRAQAFGVFQLEAGKLPHPHVRLFAFALQFCLQDGRTDIARNDGIQPALDAEIADQAGYRGFAVAAGNRNHLVAAAVHNVRQQLDVAXHAXRRFA

SEQ ID NO: 671 - protein, 118 aa, Neisseria
  VARIANT (1)...(118): Xaa = Any Amino Acid
MRIVEQVVVAVEMVFGNVQHRRRSRTQAFGVFQLEAGKLQHPHVRLFAFALPFRLQNRRADIARDNGIQPALDTEIADQARYRGFAVAAGNRNYLVVPAVHNVRQQFDVAQHAXRRFA

SEQ ID NO: 672 - protein, 118 aa, Neisseria
  VARIANT (1)...(118): Xaa = Any Amino Acid
MRVVEQVVVAVEMVFGNVQHCRRSRAQAFGVFQLETGKLQHPHVRLFAFALQFRLQNRRADIARDNGIQPTLDAEIADQARYRGFAVAAGNRNHLVAAAVHNVRQQFDVAQHAXRRFA

SEQ ID NO: 673 - protein, 459 aa, Neisseria
MTAFAFQTASQSLKRFDKHFRTVRVAFEHIKARAGGAEQHNIACFGLGICRLNGFSQSGAVGHIQAAAVQIAADLRRIDTNQEHAFCLAYQCIAQGREVLPFTHAAQNHEERILQTGNRGGSRADIRAFAVVDKHHAVFLADFFHAVRQALEGFDVFEQCFARQTDGLTQSHGSHDVSGVVQTLQRNVLRDNQIFIALFQAACLAFQPEISFVFQRKPFYLAPGTLHRAAERIVRIQNLHAVATENLGFGMRIVEQVVVAVEMVFGNVQHRRRSRTQAFGVFQLEAGKLQHPHVRLFAFALPFRLQNRRADIARDNGIQPALDTEIADQARYRGFAVAAGNRNYLVVPAVHNVRQQFDVAQHASAVLLERLNIRLPLADAGTESQNIETVVQRIFQTARVKHQPVKHLTDLRHAFRLQLRIIRSNLRAVFAQVGNHGNTRTAESGDEDFFVLKSHFGLS

SEQ ID NO: 674 - protein, 102 aa, Neisseria
MEIPVPPSPATRIFLFESHFGFVLKQIILGRRRPPLPKPLSDGIASRLITRLQALVIVAAVLVSVLTSLAKPLLSERKVLAHAASIVIHQAQIVLGLGIPLF

SEQ ID NO: 675 - protein, 102 aa, Neisseria
MEIPVPPSPATRIFLFEKSFWFVLKQIILSRRCPPLPKPLSDGIASCSITRLQALVIVAAVLVSVLTSLAKPFLCKGAVLAHAASFGIHHAQIVLGLGYPLR

SEQ ID NO: 676 - protein, 96 aa, Neisseria
MEIPVPPSPATRIFLFWKSFWFVLKQIILSRGCLILLKPLSDGIASCSITRFQALVIVAAVLVSVLTSLAKPFLCKGAVLAHAASFGIHHAQIVLG

SEQ ID NO: 677 - protein, 506 aa, Neisseria
MFFISIRYIFVRKLWCANGQTFKITPLRTKNQPERNIMMKNRVSNIHFVGIGGVGMSGIAEVLHNLGFKVSGSDQARNAATEHLSSLGIQVYPGHTAEHVNGADVVVASTAVKKENPEVVAALERQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCVDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYPEKRLVLAFQPHRYTRTRDLFEDFTKVLNTVDALVLTEVYAAGEEPVAAADSRALARAIRVLGKLEPIYCENVADLPQMLMNVLQDGDVVLNMGAGSINRVPSALLELSKQI

SEQ ID NO: 678 - protein, 506 aa, Neisseria
MFFISIRYIFVRKLWRANGQPFKITPLRIENPPERNIMMKNRVTNIHFVGIGGVGMSGIAEVLHNLGFKVSGSDQARNAATEHLGSLGIQVYPGHTAEHVNGADVVVTSTAVKKENPEVVAALEQQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCIDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYLEKRLVLAFQPHRYTRTRDLFEDFTKVLNTVDALVLTEVYAAGEEPIAAADSRALARAIRVLGKLEPIYCENVADLPEMLLNVLQDGDIVLNMGAGSINRVPAALLALSKQI

SEQ ID NO: 679 - protein, 506 aa, Neisseria
MFFISIRYIFVRKLWRANGQPFKITPLRIENPPERNIMMKNRVTNIHFVGIGGVGMSGIAEVLHNLGFKVSGSDQARNAATEHLGSLGIQVYPGHTAEHVNGADVVVTSTAVKKENPEVVAALEQQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCIDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLSAARGAYPEKRLVLAFQPHRYTRTRDLFEDFTKVLNTVDALVLTEVYAAGEEPIAAADSRALARAIRVLGKLEPIYCENVADLPEMLLNVLQDGDIVLNMGAGSINRVPAALLELSKQI

SEQ ID NO: 680 - protein, 276 aa, Neisseria
MQNFGKVAVLMGGFSSEREISLDSGTAILNALKSKGIDAYAFDPKETPLSELKERGFQTAFNILHGTYGEDGAVQGALELLGIPYTGSGVAASAIGMDKYRCKLIWQALGLPVPEFAVLYDDTDFDAVEEKLGLPMFVKPAAEGSSVGVVKVKEKGRLKSVYEELKHLQGRNHCRTFYRRRRIFLPRPERQRAARHTHHPRNRVLRLRSQVQPRRHHLSMSFGRFDRSRRKPDARTGGSRRTGNRCGRLRARRFPQRYRRQTLSVGNQHPARYDRP

SEQ ID NO: 681 - protein, 276 aa, Neisseria
  VARIANT (1)...(276): Xaa = Any Amino Acid
MQNFGKVAVLMGGFSSEREISLDSGTAILNALKSKGIDAYAFDPKETPLSELKAQGFQTAFNILHGTYGXDGAVQGALELLGIPYTGSGVAASAIGMDKYRCKLIWQALGLPVPEFAVLHDDTDFDAVEEKLGLPMFVKPAAEGSSVGVVKVKGKGRLKSVYEELKHLQXRNHCRTFYRRRRIFLPRPERQRAARHTHHSRNRVLRLRSQVQPRRHHLSMSFGRFDRSRRKPDARTGGSRRAGNRCGRLRARRFPQRYRRQTLSVGNQHPARYDEP

SEQ ID NO: 682 - protein, 275 aa, Neisseria
  VARIANT (1)...(275): Xaa = Any Amino Acid
MQNFGKVAVLMGGFSSEREISLDSGTAILNALKSKGIDAYAFDPKETPLSELKAQGFQTAFNILHGTYGEDGAVQGALELLGIPYTGSGVAASAIGMDKYRCKLIWQALGLPVPEFAVLHDDTDFDAVEEKLGLPMFVKPAAEGSSVGVVKVKGKGRLKSVYEELKHFQXRNHCRTVYRRRRIFLPCVERQRPARHTHHPRDRVLLRSQVQPQRHHLSMSFGRSDRSRRKPDARTGGSRRAGNRCGRLRARRFPQRYRRQTLSVGNQHPARYDRP

SEQ ID NO: 683 - protein, 103 aa, Neisseria
MYSPLPKRALVPAALSLPPITKVGSSPAAPRMEAVRLVVVVLPCVPAMAMPSRKRISSASIKARGITGICRSNAATTSGFSFLTAVEATTTSAPLTCSAVWPG

SEQ ID NO: 684 - protein, 103 aa, Neisseria
MYSPLPKRALVPAALSLPPITKVGSSPAAPRMEAVRLVVVVLPCVPAMAMPSRKRINSANIRARGITGICCSNAATTSGFSFLTAVEVTTTSAPLTCSAVWPG

SEQ ID NO: 685 - protein, 103 aa, Neisseria; identical to SEQ ID NO: 684

SEQ ID NO: 686 - protein, 124 aa, Neisseria
MSFHLNMDGEFHLRADVFDVGGVDVGGIVQTVSSIRFAHFGQNRADVFAVNTQKGFAVEGHTVDEIDKRLMQFFDAVPVGIHMVFVDIGNDGHNRGQCRKEASDRRLRQRCIRLCPSGRWCLRR

SEQ ID NO: 687 - protein, 124 aa, Neisseria
  VARIANT (1)...(124): Xaa = Any Amino Acid
MSFHLNMDGEFHLRADVFDVGGVDVGGIVQTVSSIRFAHFGQNRADVFAVNTQKGFAVEGHTVDEIDKRLMQFFDAVPVGIHMVFVDIGNDGHNRCQCRKDASDRRLRQRCIRLCPSGRXCLRR

SEQ ID NO: 688 - protein, 124 aa, Neisseria
MSFHLNMDGEFHLRADVFDVGGVDVGGIVQTVSSIRFAHFGQNRADVFAVNTQKGFAVEGHTVDEIDKRLMQLLNTVPVGIHMVFVDIGNDGHNRCQCRKDASDRRLRQRCIRLCPSGRWCLRR

SEQ ID NO: 689 - protein, 124 aa, Neisseria
MAGHTGQGVDFQQIEFAVGIFEEIDAHAAFRTDCLCAANRQFAHQAFFGFGQIFRRTLINGVVSVVLGFVVVKLGCGDDVYAGQPFAVQDGAGIFAAADKTFGNDFAPEGVSILRKRFSDGLFL

SEQ ID NO: 690 - protein, 124 aa, Neisseria
  VARIANT (1)...(124): Xaa = Any Amino Acid
MARHTGQGVDFQQIEFAVGIFEEIDAHAAFRTDCLRAANRQFAHQAFFGFGQIFRRTLINGVVAVVLGFVVVKLGCGNDVYAGQPFAVQDGAGIFAAADKTFGNDFAXEGVSILRKRFSDGLFL

SEQ ID NO: 691 - protein, 124 aa, Neisseria
  VARIANT (1)...(124): Xaa = Any Amino Acid
MAGHTGQGVDFQQIEFAVGIFEEIDAHAAFRTDCLRAANRQFAHQAFFGFGQIFRRTLINGVVAVVLGFVVIKLGRGDDVYAGQAFAVQHRAGIFAAADKPFGNDFAXESVSILRKRFSDGLFL

SEQ ID NO: 692 - protein, 436 aa, Neisseria
MDISKQTLLDRVFNLKANGTTVRTELMAGLTTFLTMCYIVIVNPLILGETGMDMGAVFVATCIASAIGCFVMGFIGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFVMVVVLGYFRVQGAIIITILTITVIASLMGLNEFHGVVGEVPGIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPVFATAPALLYVGTQMLRSARDIDWDDMTEAAPAFLTIVFMPFTYSIADGIAFGFISYAVVKLLCRRTGDVPPMVWVVAVLWALKFWYLG

SEQ ID NO: 693 - protein, 436 aa, Neisseria
  VARIANT (1)...(436): Xaa = Any Amino Acid
MDTSKQTLLDGIFKLKANGTTVRTELMAGLTTFLTMCYIVIVNPXILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFEGLFTVSMVSVIFVFFLVDLFDSTGTLVGISHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 694 - protein, 436 aa, Neisseria
MDTSKQTLLDGIFKLKANGTTVRTELMAGLTTFLTMCYIVIVNPLILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 695 - protein, 125 aa, Neisseria
MTADGLFVAFNFNTFAVVRILIPVQQDAAQAGDQFVGDVARFAVGMAFAFGMNAAEHGHAGTHHVHRMGMCRQAFQNFNHTDRQAAHGFELGFISGQLEFVGQMAVNQQVCDFFKLAFLCQIRMS

SEQ ID NO: 696 - protein, 125 aa, Neisseria
MTADGLFVAFNLNAFAVVRILIPVQEDAAEAGDQFVGDVARFTFRMAFTFRMNAAQHGYAGTHYVHRMGMCRQAFQNFNHTDRQAAHGFELGFISGQLEFVGQMAVNQQVGDFFKLAFLCQIRMS

SEQ ID NO: 697 - protein, 125 aa, Neisseria; identical to SEQ ID NO: 696

SEQ ID NO: 698 - protein, 639 aa, Neisseria
MLGRASMMRLPDIVGVELTGKRQAGITATDIVLALTEFLRKERVVGAFVEFFGEGARSLSIGDRATISNMTPEFGATAAMFAIDAQTIDYLKLTGRDDAQVKLVETYAKTAGLWAGGLKTAVYPRVLKFDLSSVTRNMAGPSNPHARFATADLAAKGLAKPYEEPSDGQMPDGAVIIAAITSCTNTSNPRNVVAAALLARNANRLGLKRKPWVKSSFAPGSKVAGIYLKEAGLLPEMEKLGFGIVAFACTTCNGMSGALDPKIQQEIIDRDLYATAVLSGNRNFDGRIHPYAKQAFLASPPLVVAYALAGSIRFDIENDVLGVADGREIRLKDIWPTDEEIDAIVAEYVKPQQFRDIYIPMSDTGTAQKAPSPLYDWRPMSTYIRRPPYWEGALAGERTLRGMRPPAILPDNITTDHISPSNAILAGSAAGEYLAKMGLPEEDFNSYATHRGDHLTAQRATFANPKLFNEMVRNEDGSVRQGSLARVEPEGQTMRMWEAIETYMNRKQPLIIIAGADYGQGSSRDWAAKGVRLAGVEAIAAEGFERIHRTNLIGMGVLPLQFKPGTNRHTLQLDGTETYDVVGERTPRCGLTLVIHRKNGETVEVPVTCRPDTAEEALVYEAGGVLQRFAQDFLEGNAA

SEQ ID NO: 699 - protein, 639 aa, Neisseria
MLGRASMMRLPDIVGVELNGKRQAGITATDIVLALTEFLRKERVVGAFVEFFGEGARSLSIGDRATISNMTPEFGATAAMFAIDEQTIDYLKLTGRDDAQVKLVETYAKTAGLWADALKTAVYPRVLKFDLSSVTRNMAGPSNPHARFATADLAAKGLAKPYEEPSDGQMPDGSVIIAAITSCTNTSNPRNVVAAALLARNANRLGLKRKPWVKSSFAPGSKVAEIYLKEAGLLPEMEKLGFGIVAFACTTCNGMSGALDPKIQKEIIDRDLYATAVLSGNRNFDGRIHPYAKQAFLASPPLVVAYALAGSIRFDIENDVLGVADGKEIRLKDIWPADEEIDAVVAEYVKPQQFRDVYVPMFDTGTAQKAPSPLYDWRPMSTYIRRPPYWEGALAGERTLRGMRPLAILPDNITTDHLSPSNAILAVSAAGEYLAKMGLPEEDFNSYATHRGDHLTAQRATFANPKLFNEMVKNEDGSVRQGSFARVEPEGETMRMWEAIETYMNRKQPLIIIAGADYGQGSSRDWAAKGVRLAGVEAIVAEGFERIHRTNLIGMGVLPLQFKPDTNRHTLQLDGTETYDVVGERTPRCDLTLVIHRKNGETVEVPVTCCLDTAEEVLVYEAGGVLQRFAQDFLEGNAA

SEQ ID NO: 700 - protein, 639 aa, Neisseria
MLGRASMMRLPDIVGVELNGKRKAGITATDIVLALTEFLRKERVVGAFVEFFGEGARSLSIGDRATISNMTPEFGATAAMFAIDEQTIDYLKLTGRDDAQVKLVETYAKTAGLWADALKTAVYPRVLKFDLSSVTRNMAGPSNPHARFATADLAGKGLAKPYEEPSDGQMPDGAVIIAAITSCTNTSNPRNVVAAALLARNANRLGLQRKPWVKSSFAPGSKVAEIYLKEADLLPEMEKLGFGIVAFACTTCNGMSGALDPKIQKEIIDRDLYATAVLSGNRNFDGRIHPYAKQAFLASPPLVVAYALAGSIRFDIENDVLGVADGKEIRLKDIWPTDEEIDAIVAEYVKPQQFRDVYIPMFDTGTAQKAPSPLYDWRPMSTYIRRPPYWEGALAGERTLSGMRPLAILPDNITTDHLSPSNAILASSAAGEYLAKMGLPEEDFNSYATHRGDHLTAQRATFANPKLFNEMVRNEDGSVRQGSLARVEPEGQTMRMWEAIETYMNRKQPLIIIAGADYGQGSSRDWAAKGVRLAGVEAIVAEGFERIHRTNLIGMGVLPLQFKPGTNRHTLQLDGTETYDVVGERTPRCDLTLVIHRKNGETVEVPITCRLDTAEEVLVYEAGGVLQRFAQDFLEGNAA

SEQ ID NO: 701 - protein, 414 aa, Neisseria
MSAKTPSLFGGAMIIAGKVIGAGMFPNPTANLGDGLIGSLIVLLYTWFPFSSGALMILEVNTHNPRGASFDTMVKDLLGRGWNIINGIAVALVLYGSTYAYILVGGDLTAKGIGSAVGGKISLTVGQLVFFGILAFCVWASARLVDRFTGVLIGGMVLTFIWATGGLVADAKPSVLFDTQAPVGTGYWIYAATALPVCLASFGFHGNVSSLLKYFKGDAPKVAKSIWAGTLVALVIYVLWQTAIQSNLPRNEFAPVIAAERQLSVLNETLSKFAQTGDMDKILSLFPYMAIATSFLGVTLGLFDNIADIFKWNDSMSGRGTKTVALNFLPPLISWLLLPTGFFTAIGASGLAATVWDQGIIPAMLLYVSPQKIGAGKTYKVYGGLWLMLVFLFGIANIAAQVLSQMELVPVFKG

SEQ ID NO: 702 - protein, 413 aa, Neisseria
MPNKTPSLFGGAMIIAGTVIGAGMLANPTATSGVWFTGSLAVLLYTWFSMLSSGLMILEVNTHYPHGASFDTMVKDLLGRGWNIINGIAVAFVLYLLTYAYIFVGGDLTAKGLGSAAGGDVSLTVGQLVFFGILAFCVWASARLVDRFTGVLIGGMVLTFIWAAGGLIADAKPSVLFDTQAPAGTNYWIYAATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSISGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 703 - protein, 413 aa, Neisseria
  VARIANT (1)...(413): Xaa = Any Amino Acid
MPTKTPSLFGGAMIIAGTXIGAGMLANPTATSGVWFTGSLAVLLYTWFSMLSSGLMILEVNTHYPHGAXFDTMVKDLLGRSWNIINGIAVAFVLYLLTYAYIFVGGDLTAKGLGSAAGGNVSLTVGQLVFFGILAFCVWASARLVDRFTSVLIGGMVLTFIWATGGLIADAKLPVLFDTQAPTGTNYWIYVATALPVCLASFGFHGNVSSLLKYFKGDAPKVAKSIWTGTLIALVIYVLWQTAIQXNLPRNEFAPVIAAEGQVSVXIETLSKFAQTGNMDKILSLFSYMAIATSFLGVTLGLFDYIADIFKWNDSVSGRTKTAALTFLPPXISCLLFPTGFVTAIGYVGLAATVWTGIIPAMLLYRSRKKFGAGKTYKVYGGLWLMVWVFLFGIXNIAAXVLSQMELVPVFKG

SEQ ID NO: 704 - protein, 289 aa, Neisseria
MSAETYTQIGWVGLGQMGLPMVTRLLDGGIEVGVYNRSPDKTAPISAKGAKVYGSTAELVRACPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 705 - protein, 287 aa, Neisseria
  VARIANT (1)...(287): Xaa = Any Amino Acid
MSANEYAQIGWIGLGQMGLPMVTRLLDGGIEVGVYNRSPDKTAPISAKGAKVYGNTAELVRDYPVIFLMVSDYAAVCDILNGVRDGLAGXIIVNMSTISPTEKLAVKALVEAQRQFAEAPVSGSVGPATNGTLLILFGGSEPFXTRCKKYFPSSAKKPSISAMSAKVRARNSSXTRSWAFSANVQRXXLMARQFGIDTDTIVEAIGDSAMDSPMFQTKKSLWANREFPXXFALKHASKDLNLAVKELEQAGNTLPAVETVAASYRKAVEAGYGTQDVSGVYLKLAEH

SEQ ID NO: 706 - protein, 289 aa, Neisseria
MSANEYTQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 707 - protein, 289 aa, Neisseria; identical to SEQ ID NO: 704

SEQ ID NO: 708 - protein, 289 aa, Neisseria
  VARIANT (1)...(289): Xaa = Any Amino Acid
MSANEYAQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEXMLMARQFGIDTDTIVEAIGDSAMDSPMFQTKKSLWANREFPPAFALKHASKDLNLAVKELEQAGNTLPAVETVAASYRKAVEAGYGEQDVSGVYLKLAEH

SEQ ID NO: 709 - protein, 289 aa, Neisseria; identical to SEQ ID NO: 706

SEQ ID NO: 710 - protein, 170 aa, Neisseria
MVLTFIWATGGLVADAKPSVLFDTQAPVGTGYWIYAATALPVCLASFGFHGNVSSLLKYFKGDAPKVAKSIWAGTLVALVIYVLWQTAIQSNLPRNEFAPVIAAERQLSVLNETLSKFAQTGDMDKILSLFPYMAIATSFLGVTLGLFDNIAGHLQMERQYVRAAPKPSR

SEQ ID NO: 711 - protein, 170 aa, Neisseria
  VARIANT (1)...(170): Xaa = Any Amino Acid
NMVLTFIWAAGGLIADAKPSVLFDTQAPAGTNYWIYAXTALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIAHLQMERQHLRAAPKPPR

SEQ ID NO: 712 - protein, 258 aa, Neisseria
MVLTFIWATGGLIADAKLPVLFDTQAPTGTNYWIYVATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSVSGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 713 - protein, 172 aa, Neisseria
MLPGFNRIFKRFAPTLGTAHKTPPFALSRTGRLIRSYRHKRRGFNRKGIEMNKTLSILPAAILLGGCAAGGNTFGSLDGGTGMGGSIVKMTVESQCRAELDRRSEWRLTALAMSAEKQAEWENKICGCATEEAPNQLTGNDVMQMLNQSTRNQALAALTVKTVSACFKRLYR

SEQ ID NO: 714 - protein, 173 aa, Neisseria
MLPGFNRIFKRFVPTLGTAHKTPPFALSRTGRLIRFYRHKRRGFNRKGIEMNKTLSILPVAILLGGCAAGGGNTFGSLDGGTGMGGSIVKMAVGSQCRAELDKRSEWRLTALAMSAEKQAEWENKICACVAQEAPERMTGNDVMQMLAPSTRNQALAALTAKTVSACFKHLYR

SEQ ID NO: 715 - protein, 173 aa, Neisseria
MLPGFNRIFKRFVPTLGTAHKTPPFALSRTGRLIRFYRHKRRGFNRKGIEMNKTLSILPVAILLGGCAAGGGNTFGSLDGGTGMGGSIVKMAVESQCRAELNKRSEWRLTALAMSAEKQAEWENKICACVAQEAPNQLTGNDVMQMLDPSTRNQALAALTAKTVSACFKHLYR

SEQ ID NO: 716 - protein, 122 aa, Neisseria
MYYRRVVGLSDGLGDLAAGIDRRRMLTAFGSGHGNDAQRQNHPIRRHRGVLFRLVNPVFGWALTMLLDNLGLIGCKERSAQLGFVGRVLIPAVGFLILCVAMGAVGMLPGIPPFLEQFKSLG

SEQ ID NO: 717 - protein, 126 aa, Neisseria
MYYRRVMGLSDGLGDLAAGIERSLGRRRILTAFGSGHGNDAQRQNHPIRRHRGVLFRLVNPVFGWALTMLLDNLGLIGCKERSAQLGFAGRVLIPAVGFLILCVAMGAVGMLPGIPPFLEHFKSLG

SEQ ID NO: 718 - protein, 126 aa, Neisseria
MYYRRVVGLSDGLGDLAAGIERSLGRRRILTAFGSGHGNDAQRQNHPIRRHRGVLFRLVNPVFGWALTMLLDNLGLIGCKERSAQLGFTGRVLIPVVGFLILCVAMGAVGMLPGIPPFLEHFKSLG

SEQ ID NO: 719 - protein, 120 aa, Neisseria
MPSETRLPNLIRALIFALGFIFLNACSEQTAQTVTLQGETMGTTYTVKYLSNNRDKLPSPAKIQKRIDDALKEVNRQMSTYQTDSEISRFIQTAGELFAHASITDSAEDCLPNTPISSAL

SEQ ID NO: 720 - protein, 351 aa, Neisseria
  VARIANT (1)...(351): Xaa = Any Amino Acid
MPSETRLPNFIRVLIFALGFIFLNACSEQTAQTVTLQGETMGTTYXVKYLSNNRDKLPSPAEIXKRIDDALKEXNRXMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 721 - protein, 351 aa, Neisseria
MPSETRLPNFIRTLIFALSFIFLNACSEQTAQTVTLQGETMGTTYTVKYLSNNRDKLPSPAEIQKRIDDALKEVNRQMSTYQPDSEISRFNQHTAGKPLRISSDFAHVTAEAVHLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKSGKRLSHIINPNNKRPISHNLASISVVADSAMTADGLSTGLFVLGETEALKLAEREKLAVFLIVRDKGGYRTAMSSEFEKLLR

SEQ ID NO: 722 - protein, 351 aa, Neisseria; identical to SEQ ID NO: 256

SEQ ID NO: 723 - protein, 351 aa, Neisseria; identical to SEQ ID NO: 254

SEQ ID NO: 724 - protein, 351 aa, Neisseria; identical to SEQ ID NO: 721

SEQ ID NO: 725 - protein, 140 aa, Neisseria
MASITSPLHGAQQECSKTFLCPPGGTSMGRSMSVTVGLFCVSINLTISVEYGQSGYFTRAAECKTGCQGISPSCLNERTVCEVTIKWSSSETSTSDMACASRLVNMMSSCEGSGEPPGWLCAIIRLSAYSSNASLTISRM

SEQ ID NO: 726 - protein, 140 aa, Neisseria
  VARIANT (1)...(140): Xaa = Any Amino Acid
MASITSPLHGAHRECSKTFLCPPGGTSIGRSMSVTVGLFCVSINLTISVEYGXSGYFIRAAACKTECQGINPSCLNEQTLCXVTIKWSSSDTSTSDIACASRLVNMMSSCEXSGEPPGWLCAIIRLSAYSSNASLTISRM

SEQ ID NO: 727 - protein, 144 aa, Neisseria
MPEASIASITSPLHGAQQECSKTFLCPPGGTSMGRSMSVTVGLFCVSINLTISVEYGSGYFIRAAACKTGCQGISPSCLNERTVCAVTIKWSSSDTSTSDIACASRLVNMMSSCEGSGEPPGWLCAIIRLSAYSSNASLTISRM

SEQ ID NO: 728 - protein, 668 aa, Neisseria
MVDELDLLPDAVAATLLADIGRYVPDWNLLVSERCNSTVAELVKGVDEVQKLTHFARVDSLATPEERAQQAETMRKMLLAMVTDIRVVLIKLAMRTRTLLFLSNAPDSPEKRAVAKETLDIFAPLANRLGVWQLKWQLEDLGFRHQEPEKYREIALLLDEKRTERLEYIENFLDILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSGKAIGKIRAYIRQQNADTVREEGRVQLDKQLAKLTPKPNLQELAENLGYKKPEDLYTAVGQGEISNRAIQKACGTLNEPPPVPVSATTIVKQSKIKKGGKTGVLIDGEDGLMTTLAKCCKPAPPDDIAGFVTRERGISVHRKTCPSFRHLAEHAPEKVLDASWAALQEGQVFAVDIEIRAQDRSGLLRDVSDALARHKLNVTAVQTQSRDLEASMRFTLEVKQVNDLPRVLAGLGDVKGVLSVTRL

SEQ ID NO: 729 - protein, 491 aa, Neisseria
  VARIANT (1)...(491): Xaa = Any Amino Acid
VKLKKYNVHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIIGFVTRERGISVHRKXXXSFQHLAEHAPXKVLDASWAALQEGQVFAVDIEIRAQDRSGLLRDVSDALARHKLNVTAVQTQSRDLEASMRFTLEVKQVNDLPRVLASLGDVKGVLSVTRL

SEQ ID NO: 730 - protein, 668 aa, Neisseria
MVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLNILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIVGFVTRDRGISVHRKTCPSFRHLAEHAPEKVLDASWAALQEGQVFAVDIEIRAQDRSGLLRDVSDALARHKLNVTAVQTQSRDLEASMRFTLEVKQVTDLPRVLASLGDVKGVLSVTRL

SEQ ID NO: 731 - protein, 737 aa, Neisseria
MTAISPIQDTQSATLQELREWFDSYCAALPDNDKNLIGTAWSLAQEHYPADAATPYGEPLPDHFLGAAQMVDELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLDILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEEKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSGKAIGKIRAYIRQQNADTVREEGRVQLDKQLAKLTPKPNLQELAENLGYKKPEDLYTAVGQGEISNRAIQKACGTLNEPPPVPVSATTIVKQSKIKKGGKTGVLIDGEDGLMTTLAKCCKPAPPDDIAGFVTRERGISVHRKTCPSFRHLAEHAPEKVLDASWAALQEGQVFAVDIEIRAQDRSGLLRDVSDALARHKLNVTAVQTQSRDLEASMRFTLEVKQVNDLPRVLAGLGDVKGVLSVTRL

SEQ ID NO: 732 - protein, 737 aa, Neisseria
MTAISPIQDTQSATLQELREWFDSYCAALPDNDKNLIGTAWLLAQEHYPADAATPYGEPLPDHFLGAAQMVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQKPEKYREIALLLDEKRTERLEYIENFLNILRGELKKYNVHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIIGFVTRERGISVHRKTCPSFQHLAEHAPEKVLDASWAALQEGQVFAVDIEIRAQDRSGLLRDVSDALARHKLNVTAVQTQSRDLEASMRFTLEVKQVNDLPRVLASLGDVKGVLSVTRL

SEQ ID NO: 733 - protein, 737 aa, Neisseria
MTAISPIQDTQSATLQELREWFDSYCTALPNNDKKLVLAARSLAEAHYPADAATPYGEPLPDHFLGAAQMVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLNILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIVGFVTRDRGISVHRKTCPSFRHLAEHAPEKVLDASWAALQEGQVFAVDIEIRAQDRSGLLRDVSDALARHKLNVTAVQTQSRDLEASMRFTLEVKQVTDLPRVLASLGDVKGVLSVTRL

SEQ ID NO: 734 - protein, 125 aa, Neisseria
MCEFKDFRRNIPCFEEYDENSFIGKWYDDGVWDDEEYWKLENDLIEVRRKYPYPMDIPRDIVIGIGTIIDFLMVPNWELFEIKASPWLPDSVGIHERYERFTTMLRYIFTEKDIVNVRFDYYNKK

SEQ ID NO: 735 - protein, 125 aa, Neisseria
MCEFKDIIRNVPYFEGYDENSFIGKWYDDGVWDDEEYWKLENDLIEVRKKYPYPMDIPRYVVIGIGTIIDFLMVPNWKLFEIKASPWLPDSVGIHERYERFTTMLRYIFTEKDIVNVRFDYYNKK

SEQ ID NO: 736 - protein, 125 aa, Neisseria
MCEFKDFRRNIPCFEEYDENSFIGKWYDDGVWDDEEYWKLENDLIEVRKKYPYPMDIPRDIVIGIGTIIDFLMVPNWELFEIKASPWLPDSVGIHERYERFTTMLRYIFTEKDIVNVRFDYYNKK

SEQ ID NO: 737 - protein, 223 aa, Neisseria; identical to SEQ ID NO: 421

SEQ ID NO: 738 - protein, 223 aa, Neisseria
  VARIANT (1)...(223): Xaa = Any Amino Acid
MMKTFKNIFSAAILSAALPCAYAAGLPQSAVLXYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 739 - protein, 223 aa, Neisseria; identical to SEQ ID NO: 419

SEQ ID NO: 740 - protein, 366 aa, Neisseria
METQLYIGIMSGTSMDGADAVLVRMDGGKWLGAEGHAFTPYPDRLRRKLLDLQDTGTDELHRSRMLSQELSRLYAQTAAELLCSQNLAPCDITALGCHGQTVRHAPEHGYSIQLADLPLLAELTRIFTVGDFRSRDLAAGGQGAPLVPAFHEALFRDDRETRVVLNIGGIANISVLPPGAPAFGFDTGPGNMLMDAWTQAHWQLPYDKNGAKAAQGNILPQLLGRLLAHPYFSQPHPKSTGRELFALNWLETYLDGGENRYDVLRTLSRFTAQTVWDAVSHAAADARQMYICGGGIRNPVLMADLAECFGTRVSLHSTAELNLDPQWVEAAAFAWLAACWINRIPGSPHKATGASKPCILGAGYYY

SEQ ID NO: 741 - protein, 366 aa, Neisseria
  VARIANT (1)...(366): Xaa = Any Amino Acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAXXXXXXXXXXXXXXXXXXXXXXXXXXXXXXXXXXXXXXXXXXXXXXXXXXXXXXXXXXXXXXXXXXXXXXXXXXXXXXXXXQLPYDKNGAKSAQGNILPQLLDRLLAHPYFAQRHPKSTGRELFAINWLETYLDGGENRYDVLRTLSRFTAQTVCDAVSHAAADARQMYICDGGIRNPVLMADLAECFGTRVSLHSTADLNLDPQWVEAAXFAWLAACWINRIPGSPHKATGASKPCILXAGYYY

SEQ ID NO: 742 - protein, 366 aa, Neisseria
METQLYIGIMSGTSMDGADAVLIRMDGGKWLGAEGHAFTPYPGRLRRKLLDLQDTGADELHRSRMLSQELSRLYAQTAAELLCSQNLAPSDITALGCHGQTVRHAPEHSYSVQLADLPLLAERTQIFTVGDFRSRDLAAGGQGAPLVPAFHEALFRDDRETRAVLNIGGIANISVLPPDAPAFGFDTGPGNMLMDAWMQAHWQLPYDKNGAKAAQGNILPQLLDRLLAHPYFAQPHPKSTGRELFALNWLETYLDGGENRYDVLRTLSRFTAQTVFDAVSHAAADARQMYICGGGIRNPVLMADLAECFGTRVSLHSTAELNLDPQWVEAAAFAWMAACWVNRIPGSPHKATGASKPCILGAGYYY

SEQ ID NO: 743 - protein, 366 aa, Neisseria
  VARIANT (1)...(366): Xaa = Any Amino Acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAERTRIFTVGDFRSRDLAAGGQGAPLVPAFHEALFRDNRETRAVLNIGGIANISVLPPDAPAFGFDTGPGNMLMDAWTQAHWQLPYDKNGAKAAQGNILPQLLDRLLAHPYFAQPHPKSTGRELFALNWLETYLDGGENRYDVLRTLSRFTAQTVCDAVSHAAADARQMYICGGGIRNPVLMADLAECFGTRVSLHSTADLNLDPQWVEAAXFAWLAACWINRIPGSPHKATGASKPCILXAGYYY

SEQ ID NO: 744 - protein, 366 aa, Neisseria; identical to SEQ ID NO: 742

SEQ ID NO: 745 - protein, 243 aa, Neisseria
MALLSIRKLHKQYGSVTAIQSLDLDLEKGEVIVLLGPSGCGKSTLLRCVNGLEPHQGGSIVMDGVGEFGKDVSWQTARQKVGMVFQSNELFAHMTVIENIFLGPVKEQNRDRAEAEAQAGKLLERVGLLDRKNAYPRELSGGQKQRIAIVRALCLNPEVILLDEITAALDPEMVREVLEVVLELAREGMSMLIVTHEMGFARKVADRIVFMDKGGIVESSDPETFFSAPKSERARQFLAGMDY

SEQ ID NO: 746 - protein, 253 aa, Neisseria
  VARIANT (1)...(253): Xaa = Any Amino Acid
VVMIKIRNIHKTFGENTILRGIDLDVCKGQVVVILGPSGSGKTTFLRCLNALEMPEDGQIEFDNERPLKIDFSKKPSKHDILALRRKSXMVFQQYNLFPHKTALENVMEGPVAVQGKPAAQAREEALKLLEKVGLGDKVDLYPYQLSGGQQQRVGIARALAIQPELMLFDEPTSALDPELVQDVLDXMKELAQEGWTMVVVTHEIKFALEVATTXVVMDXGVIVEQGSPQDLFDHPKHERTRRFLSQIQSTKI

SEQ ID NO: 747 - protein, 253 aa, Neisseria
VVMIKIRNIHKTFGKNTILRGINLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLNAMKELAREGWTMVVVTHEIKFALEVATTVVVMDGGVIVEQGSPKELFDHPKHERTRRFLSQIQSTKI

SEQ ID NO: 748 - protein, 251 aa, Neisseria
MIKIRNIHKTFGENTILRGIDLDVGKGQVVVILGPSGSGKTTFLRCLNALEMPEDGQIEFDNARPLRIDFSKKTSKHDILALRRKSGMVFQQYNLFPHKTVLENVMEGPVAVQGKPAAQAREEALKLLEKVGLGDKVDLYPYQLSGGQQQRVGIARALAIQPELMLFDEPTSALDPELVQDVLDAMKELAREGWTMVVVTHEIKFTLEVATNVVVMDGGVIVEQGSPKELFDHLKHERTRRFLSQIQSAKI

SEQ ID NO: 749 - protein, 251 aa, Neisseria
MIKIRNIHKTFGENTILRGIDLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLDTMKELAQEGWTMVVVTHEIKFALEVATTVVVMDGGVIVEQGSPQDLFDHPKHERTRRFLSQIQSTKI

SEQ ID NO: 750 - protein, 251 aa, Neisseria
MIKIRNIHKTFGKNTILRGINLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLNAMKELAREGWTMVVVTHEIKFALEVATTVVVMDGGVIVEQGSPKELFDHPKHERTRRFLSQIQSTKI

SEQ ID NO: 751 - protein, 1 aa, Neisseria
C

SEQ ID NO: 752 - protein, 342 aa, Neisseria
  VARIANT (1)...(342): Xaa = Any Amino Acid
MSGNASSPSSSSAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAXLGAAGILAVVLSTVTTTFLDAYSAGASANNISARFAETPVAVXVTLIGTVLAVMLPVTEYENFLLLIGSVFAPMAGGFDCRLFRLETA

SEQ ID NO: 753 - protein, 342 aa, Neisseria
  VARIANT (1)...(342): Xaa = Any Amino Acid
MSGNASSPSSSAAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAGLGAAGILAVVLSTVTTTFLDAYSAGVSANNISAKLSEIPIAVAVAVVGTLLAVLLPVTEYENFLLLIGSVFAPMAXGFDCRLFRLETA

SEQ ID NO: 754 - protein, 288 aa, Neisseria
MPSETPKARRRLSDGIASDNHTKESIMLTLYGETFPSRLLLGTAAYPTPEILKQSVRTARPAMITVSLRRTGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALKILRERLPDTPLIIDAGLGLPSQAAQVMEWGFDGVLLNTAVSRSGDPVNMARAFALAVESGRLAFEAGPVEARTKAQASTPTVGQPFWHSAEY

SEQ ID NO: 755 - protein, 269 aa, Neisseria
HYTKEPIMLTLYGETFPSRLLLGTAAYPTPEILKQSIQTAQPAMITVSLRRAGSGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 756 - protein, 272 aa, Neisseria
LLIHYTKEPIMLTLYSETFPSRLLLGTAAYPTPEILKQSVRTARPAMITVSLRRAGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 757 - protein, 262 aa, Neisseria
MLTLYGETFPSRLLLGTAAYPTPEILKQSVRTARPAMITVSLRRTGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALKILRERLPDTPLIIDAGLGLPSQAAQVMEWGFDGVLLNTAVSRSGDPVNMARAFALAVESGRLAFEAGPVEARTKAQASTPTVGQPFWHSAEY

SEQ ID NO: 758 - protein, 262 aa, Neisseria
MLTLYGETFPSRLLLGTAAYPTPEILKQSIQTAQPAMITVSLRRAGSGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 759 - protein, 262 aa, Neisseria
MLTLYSETFPSRLLLGTAAYPTPEILKQSVRTARPAMITVSLRRAGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 760 - protein, 290 aa, Neisseria
MEIWNMLNTWPDAVPIRAEAAESVAAVAALLLARALLLNIHFRRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRYLENVQAEKLFITPAARPRVTRVPYDDKAYRIIVRFASPVSKRLEIQQAVMDEFLRVQYRLLNHPAGSETL

SEQ ID NO: 761 - protein, 290 aa, Neisseria
  VARIANT (1)...(290): Xaa = Any Amino Acid
MEIWNMLDTWLGAVPIRAEAVESVAAVAALLLARALLLNIHFKRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRXLENVQAEKLFITPAARPRVTRVPYDDKAYRIIVRFASPVSKRLEIQQAVMDEFLRVQYRLLNHPAGSETL

SEQ ID NO: 762 - protein, 290 aa, Neisseria
MEIWNMLDTWLGAVPIRAEAVESVAVVAALLLARALLLNIHFKRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRHLENVQAEKLFITPAAKPRVTRVPYDDKAYRIIVRFASPVSKRLEIQQAVMDEFLRVQYRLLNYPAGSETL

SEQ ID NO: 763 - protein, 678 aa, Neisseria
MIDNALLHLGEEPRFNQIQTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVEWDAVELPSQFMENFVWEYNVLAQMSAHEETGEPLPKELFDKMLAAKNFQRGMFLVRQMEFALFDMMIYSESDECRLKNWQQVLDSVRKEVAVIQPPEYNRFANSFGHIFAGGYSAGYYSYAWAEVLSTDAYAAFEESDDVAATGKRFWQEILAVGGSRSAAESFKAFRGREPSIDALLRQSGFDNAA

SEQ ID NO: 764 - protein, 476 aa, Neisseria
  VARIANT (1)...(476): Xaa = Any Amino Acid
MTDNALLHLGEEPRFDQIKTEDIKPALQTAIAEAREQIAAIKAQTHTGWANTVEPLTGITERVGRIWGVVSHLNCVADTPELRAVYNELMPEITVFFTEIGQDIELYNRFKTIKNSPEFDTLSPAQKTKLNHYASEKLREAKYAFSETXVKKYFPVGXVLNGLFAQXKKLYGIGFTEKTVPVWHKDVRYXELQQNGEXIGGVYMDLYAREGKRGGAWMNDYKGRRRFSDGTLQLPTAYLVCNFAPPVGGREARLSHDEILILFHETGHGLHHLLTQVDELGVSGINGVXWDAVELPSQFMENFVWEYNVLAQXSAHEETGVPLPKELXDKXLAAKNFQXGMFXVRQXEFALFDMMIYSEDDEGRLKNWQQVLDSVRKKVAVIQPPEYNRFALSFGHIFAGGYSAAXYSYAWAEVLSADAYAAFEESDDVAATGKRFWQEILAVGXSRSGAESFKAFRGREPSIDALLRHSGFDNAV

SEQ ID NO: 765 - protein, 678 aa, Neisseria
MTDNALLHLGEEPRFDQIKTEDIKPALQTAIAEAREQIAAIKAQTHTGWANTVEPLTGITERVGRIWGVVSHLNSVTDTPELRAAYNELMPEITVFFTEIGQDIELYNRFKTIKNSPEFDTLSHAQKTKLNHDLRDFVLSGAELPPEQQAELAKLQTEGAQLSAKFSQNVLDATDAFGIYFDDAAPLAGIPEDALAMFAAAAQSEGKTGYKIGLQIPHYLAVIQYADNRKLREQIYRAYVTRASELSDDGKFDNTANIDRTLENALQTAKLLGFKNYAELSLATKMADTPEQVLNFLHDLARRAKPYAEKDLAEVKAFARESLGLADLQPWDLGYAGEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFTPPVGGKEARLSHDEILTLFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKEVAVVRPPEYNRFANSFGHIFAGGYSAGYYSYAWAEVLSADAYAAFEESDDVAATGKRFWQEILAVGGSRSAAESFKAFRGREPSIDALLRHSGFDNAA

SEQ ID NO: 766 - protein, 491 aa, Neisseria
MIDNALLHLGEEPRFNQIKTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVK

SEQ ID NO: 767 - protein, 678 aa, Neisseria
MTDNALLHLGEEPRFDQIKTEDIKPALQTAIAEAREQIAAIKAQTHTGWANTVEPLTGITERVGRIWGVVSHLNSVADTPELRAVYNELMPEITVFFTEIGQDIELYNRFKTIKNSPEFDTLSPAQKTKLNHDLRDFVLSGAELPPEQQAELAKLQTEGAQLSAKFSQNVLDATDAFGIYFDDAAPLAGIPEDALAMFAAAAQSESKTGYKIGLQIPHYLAVIQYADNRELREQIYRAYVTRASELSDDGKFDNTANIDRTLANALQTAKLLGFKNYAELSLATKMADTPEQVLNFLHDLARRAKPYAEKDLAEVKAFARESLNLADLQPWDLGYASEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFAPPVGGREARLSHDEILILFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKKVAVIQPPEYNRFALSFGHIFAGGYSAGYYSYAWAEVLSADAYAAFEESDDVAATGKRFWQEILAVGGSRSAAESFKAFRGREPSIDALLRHSGFDNAV

SEQ ID NO: 768 - protein, 678 aa, Neisseria; identical to SEQ ID NO: 765

SEQ ID NO: 769 - protein, 168 aa, Neisseria
MLSPPRRKTAAHQSSRLSFACGKNAACCRDQNQYRAASSPNRGLPRFPITPTAAAVHPYPRFRHLPFQAAGIGAEQAAVESCFIRTNALAVGKSGRPCQIMRYFGRVLSFVSGGLFLRAIRICLGAWQTAAAVQSKCLAISCRQASGCRPTYRAGFCLSDLAAFRPVT

SEQ ID NO: 770 - protein, 110 aa, Neisseria
  VARIANT (1)...(110): Xaa = Any Amino Acid
YLRFHYLPFQAAGIGTEQVAVKSCFIQINTLVVGKFGRLCQIMRYFGRVLFFVSGGLFLRVIPICLSAXQMVAAVQSKCLAISCRXASGCCPTYXAGFCLSDLTAFRPVT

SEQ ID NO: 771 - protein, 107 aa, Neisseria
YLRFHYLPFQAAGIGTEQVAVKSCFIQINTLVVGKFGQLCQIMRYFGRVLFFVSGGLFLRVIPICLSAQMVAAVQSKCLAISCRASWCCPTYAGFCLSDLTAFRPVT

SEQ ID NO: 772 - protein, 279 aa, Neisseria
MKQLRDNKAQGSALFTLVSGIVIVIAVLYFLIKLAGSGSFGDVDATTEAATQTRIQPVGQLTMGDGIPVGERQGEQIFGKICIQCHAADSNVPNAPKLEHNGDWAPRIAQGFDTLFQHALNGFNAMPAKGGAADLTDQELKRAITYMANKSGGSFPNPDEAAPADNAASGTASAPADSAAPAEAKAEDKGAAAPAVGVDGKKVFEATCQVCHGGSIPGIPGIGKKDDWAPRIKKGKETLHKHALEGFNAMPAKGGNAGLSDDEVKAAVDYMANQSGAKF

SEQ ID NO: 773 - protein, 204 aa, Neisseria
  VARIANT (1)...(204): Xaa = Any Amino Acid
GEQIFGKICIQCHAADSNVPNAPKLEHNGDXAPRIQGFDTLFQHALNGFNAMPAKGGAADLTDQELKRAITYMANKSGGSFPNPDEAAPADNAASGTASAPADSAAPAEAKAEDKGAAPAVGVDGKKVFEATCQVCHGGSIPGIPGIGKKDDWAPRIKKGKETLHKHALEGFNAMPAKXGNAGLSDDEVKAAVDYMANQSGAKF

SEQ ID NO: 774 - protein, 279 aa, Neisseria
MKQLRDNKAQGSALFTLVSGIVIVIAVLYFLIKLAGSGSFGDVDATTEAATQTRIQPVGQLTMGDGIPVGERQGEQIFGKICIQCHAADSNVPNAPKLEHNGDWAPRIAQGFDTLFQHALNGFNAMPAKGGAVDLTDQELKRAITYMANKSGGSFPNPDEAAPADNAASGTASAPADSAAPAEAKAEDKGAAAPAVGVDGKKVFEATCQVCHGGSIPGIPGIGKKDDWAPRIKKGKETLHKHALEGFNAMPAKGGNAGLSDDEVKAAVDYMANQSGAKF

SEQ ID NO: 775 - protein, 125 aa, Neisseria
MEAFKTLIWIINIISALAVIVLVLLQHGKGADAGATFGSGSGSAQGVFGSAGNANFLSRSTAVAATFFFATCMGYGVYSHPHDKTRFGLQQHTTDSASTQTRKQYRTFCPCSSAAEITVFQMPTW

SEQ ID NO: 776 - protein, 38 aa, Neisseria
MEPFKTLIWIVNLISALAVFVLVLLQHGKGADAGATFG

SEQ ID NO: 777 - protein, 125 aa, Neisseria
MEAFKTLIWIVNIISALAVIVLVLLQHGKGADAGATFGSGSGSAQGVFGSAGNANFLSRSTAVAATFFFATCMGYGVYSHPHDKTRFGLQQRTTNSASTQTRKQYRTFCPCSSAAEITVFQMPTW

SEQ ID NO: 778 - protein, 531 aa, Neisseria
MSQEILDQVRRRRTFAIISHPDAGKTTLTEKLLLFSGAIQSAGTVKGKKTGKFATSDWMDIEKQRGISVASSVMQFDYKDHTVNLLDTPGHQDFSEDTYRVLTAVDSALMVIDAAKGVEAQTIKLLNVCRLRDTPIVTFMNKYDREVRDSLELLDEVEDILQIRCAPVTWPIGMGKNFKGVYHILNDEIYLFEAGGERLPHEFDIIKGINNPELEQRFPLEIQQLRDEIELVQAASNEFNLDEFLAGELTPVFFGSAINNFGIQEILNSLIDWAPAPKPRDATMRMVGPDEPKFSGFIFKIQANMDPKHRDRIAFLRVCSGKFERGMKMKHLRINREIAASSVVTFMSHDRELAEEAYAGDIIGIPNHGNIQIGDSFSEGEQLAFTGIPFFAPELFRSVRIKNPLKIKQLQKGLQQLGEEGAVQVFKPMSGADLILGAVGVLQFEVVTSRLANEYGVEAVFDSASIWSARWVSCDDKKKLAEFEKANAGNLAIDAGGNLAYLAPNRVNLGLTQERWPDIVFHETREHSVKL

SEQ ID NO: 779 - protein, 531 aa, Neisseria
MSQEILDQVRRRRTFAIISHPDAGKTTLTEKLLLFSGAIQSAGTVKGKKTGKFATSDWMEIEKQRGISVASSVMQFDYKDHTVNLLDTPGHQDFSEDTYRVLTAVDSALMVIDAAKGVEAQTIKLLNVCRLRDTPIVTFMNKYDREVRDSLELLDEVENILKIRCAPVTWPIGMGKNFKGVYHILNDEIYLFEAGGERLPHEFDIIKGIDNPELEQRFPLEIQQLRDEIELVQAASNEFNLDEFLAGELTPVFFGSAINNFGIQEILNSLIDWAPAPKPRDATVRMVEPDEPKFSGFIFKIQANMDPKHRDRIAFLRVCSGKFERGMKMKHLRINREIAASSVVTFMSHDRELVEEAYAGDIIGIPNHGNIQIGDSFSEGEQLAFTGIPFFAPELFRSVRIKNPLKIKQLQKGLQQLGEEGAVQVFKPMSGADLILGAVGVLQFEVVTSRLANEYGVEAVFDSASIWSARWVSCDDKKKLAEFEKANAGNLAIDAGGNLAYLAPNRVNLGLTQERWPDIVFHETREHSVKL

SEQ ID NO: 780 - protein, 531 aa, Neisseria
MSQEILDQVRRRRTFAIISHPDAGKTTLTEKLLLFSGAIQSAGTVKGKKTGKFATSDWMDIEKQRGISVASSVMQFDYKDHTVNLLDTPGHQDFSEDTYRVLTAVDSALMVIDAAKGVEAQTIKLLNVCRLRNTPIVTFMNKYDREVRDSLELLDEVENILQIRCAPVTWPIGMGKNFKGVYHILNDEIYLFEAGGERLPHEFDIIKGIDNPELEQRFPLEIQQLRDEIELVQAASNEFNLDEFLAGELTPVFFGSAINNFGIQEILNSLIEWAPAPKPRDATVRMVEPDEPKFSGFIFKIQANMDPKHRDRIAFLRVCSGKFERGMKMKHLRINREIAASSVVTFMSHDRELVEEAYAGDIIGIPNHGNIQIGDSFSEGEQLTFTGIPFFAPELFRSVRIKNPLKIKQLQKGLQQLGEEGAVQVFKPMSGADLILGAVGVLQFEVVTSRLANEYGVEAVFDNASIWSARWVSCDDKKKLAEFEKANAGNLAIDAGGNLAYLAPNRVNLGLTQERWPDIVFHETREHSVKL

SEQ ID NO: 781 - protein, 295 aa, Neisseria
MKYKRIVFKVGTSSITRSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAIPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDSLAEAAEHQADGSFFVPRAKGLRTQKQWLAFYSESGGSVYVDESAEHALSEQGKAC

SEQ ID NO: 782 - protein, 369 aa, Neisseria
MKYKRIVFKVGTSSITHSDGSLSRGKIQTITCQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDALAEAAEHQADGSFFVPRAKGLRTQKQWLAFYSESRGSVYVDEGAEHALSEQGKSLLMSGIAGIEGHFSRMDTVTVYSKATKQPLGKGRVLFGSAAAEDLLKSRKAKGVFIHRDDWISITPEIRLLLTEF

SEQ ID NO: 783 - protein, 369 aa, Neisseria
MKYKRIVFKVGTSSITHSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIATESGVPVYICSSLKPDALAEAADNQADGSFFVPRAKGLRTQKQWLAFYSESRGGVYVDEGAEHALSEQGKSLLMSGIAGIEGHFSRMDTVTVYSKATKQPLGKGRVLFGSAAAEDLLKLRKAKGVFIHRDDWISITPEIRLLLTEF

SEQ ID NO: 784 - protein, 223 aa, Neisseria
MEIRFQTAFLRLVQMKTNASILTATRLVFPAAAARTGIVPAGFFPFPADGLRFVDDRLPVAVDVCQRVRQFGRKFRQLAFGELQADNAVFLFVVNAAHCHHGVKQLFKRFIIGGFKPIGRHNVQTVKIGVAPSVKIAAALAVVVEPQIGQLFIRHRGGCFHRHCQNQPFDFGTFGGGKLRFVAQHFGQPVERCQFVRPAQQRRHKTLNLVATHRVALFAFGIQ

SEQ ID NO: 785 - protein, 243 aa, Neisseria
METNASILTATRLVFSAAAARTGIVPACFFAFPADGLRFVDDCLPVAVDIRQCIRQLGFQFRQLAFCELQTDSAVFLFVVNTAQCHDGIKQLFKRFIIDGFKPIGRHNIQTVKISIAPCVKIAAAVFVFIQPQIGQFFIRHRGGCFHRHCQNQPFDFGTFGGGKLRFVAQHFGQPVERCQFVRPAQQRRHKTLNLVATHRVALFAFGIQQFAQPPFGCFGKFSGIHHFPFQMGFAPYYRRNAV

SEQ ID NO: 786 - protein, 278 aa, Neisseria
METNASILTATRLVFSAAAARTGIVPACFFAFPADGLRLVDDRLPVAVDIRQCIRQLGFQFRQLAFCELQTDSAVVLFVVNTAQCHDGIKQLFKRFIIDGFKPIGRHNIQTVKISIAPCVKIAAAVFVFIQPQIGQFFIRHRGGCFHRHCQNQPFDFGTFGGGKLRFVAQHFGQPVERCQFVRPAQQRRHKTLNLVATHRVALFAFGIQQFAQPPFGCFGKFSGIHHFPFPMGFAPYYSGLNLNQDKATKPQTVQIVRQGEATPYWFKFNPLYRRNAV

SEQ ID NO: 787 - protein, 283 aa, Neisseria
MIIHHQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIWLFSRKHGIGFLKLMDTVAPLVPLGLASGRIGNFINGELWGRITDINAFWAMGFPQAHYEDAEAAAHNPLWAEWLQQYGMLPRHPSQLYQFALEGICLFAVVWLFSKKPRPTGQTAALFLGGYGVFRFIAEFARQPDDYLGLLTLGLSMGQWLSVPMIVLGIVGFVRFGMKKQH

SEQ ID NO: 788 - protein, 283 aa, Neisseria
MITHPQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIRLFGRKHGIGFLKLMDTVAPLVPLGLASGRIGNFINGELWGRVTDINAFWAMGFPQARYEDAEAAAHNPLWAEWLQQYGMLPRHPSQLYQFALEGICLFTVIWLFSKKQRSTGQVASLFLGGYGIFRFIAEFARQPDDYLGLLTLGLSMGQWLSVPMIVLGIVGFVRFGMKKQH

SEQ ID NO: 789 - protein, 283 aa, Neisseria
MITHPQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIWLFGRKHGIGFLKLMDTVAPLVPLGLASGRIGNFINGELWGRVTDINAFWAMGFPQARYEDLEAAAHNPLWAEWLQQYGMLPRHPSQLYQFALEGICLFAVVWLFSKKQRPTGQVASLFLGGYGIFRFIAEFARQPDDYLGLLTLGLSMGQWLSVPMIVLGIVGFVRFGMKKQH

SEQ ID NO: 790 - protein, 298 aa, Neisseria
MEFENIISAADKARILAEALPYIRRFSGSVAVIKYGGNAMTEPALKEGFARDVVLLKLVGIHPVIVHGGGPQINAMLEKVGKKGEFVQGMRVTDKETMDIVEMVLGGHVNKEIVSMINTYGGHAVGVSGRDDHFIKAKKLLVDTPEQNSVDIGQVGTVESIDTGLVKGLIERGCIPVVAPVGVGEKGEAFNINADLVAGKLAEELNAEKLLMMTNIAGVMDKTGNLLTKLTPKRIDGLIADGTLYGGMLPKIASAVEAAVNGVKATHIIDGRLPNALLLEIFTDAGIGSMILGRGEDA

SEQ ID NO: 791 - protein, 298 aa, Neisseria
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRLPNALLLEIFTDAGIGSMILGGGEDA

SEQ ID NO: 792 - protein, 298 aa, Neisseria
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRVPNALLLEIFTDAGIGSMILGGGEDA

SEQ ID NO: 793 - protein, 178 aa, Neisseria
MRTTSTFPTKTFKPAAMALAVATTLSACLGGGGGGTSAPDFNAGGTGIGSNSRATIAESAAVSYAGIKNEMCKDRSMLCAGRDDVAVTDRDAKIKAPRICIPETFQTQMTNIKNMINLKPAIEAGYTGRGVEVGIVDTGESVGSISFPELYGRKEHGYNENYKNKLQKLYGVYAEGSA

SEQ ID NO: 794 - protein, 175 aa, Neisseria
MRTTPTFPTKTFKPTAMALAVATTLSACLGGGGGGTSAPDFNAGGTGIGSNSRATTAKSAAVSYAGIKNEMCKDRSMLCAGRDDVAVTDRDAKINAPPRICIPETFQTQMTHYKNLINLKPAIEAGYTGRGVEVGIVDTGESVGSISFPELYGRKEHGYNENYEKLYGVYAEGSA

SEQ ID NO: 795 - protein, 175 aa, Neisseria
  VARIANT (1)...(175): Xaa = Any Amino Acid
MRTTPTFPTKTFKPAAMALAVATTLSACLGGGGGGTSAPDFNAGGTGIGSNSRATTAKSAAISYAGIKNEMCKDRSMLCAGRDDVAVTDRDAKINAPPRICIPETLQTQMTHXKNLINLKPAIEAGYTGRGVEVGIVDTGESVGSISFPELYGRKEHGYNENYXKLYGVYAEGSA

SEQ ID NO: 796 - protein, 454 aa, Neisseria
MSARGKGAGYLNSTGRHVPFLSAAKIGQDYSFFKNIKTDGGLLASLDSVEKTAGSEGDTPSYYVRRGNAARTASAAAHSAPAGLKHAVEQGGSNLENLMVELDASESSATPETVETAVADRTDMPGIRLRRTTFRTAAAVQHANTADGVRIFNSLAATVYADSAAAHADMQGRRLKAVSDGLDHNGTGLRVIAQTQQDGGTWEQGGVEGKMRGSTQTIGIAAKTGENTTAAATLGIGRSTWSENSANAKTDSISLFAGIRHDVGDIGYLKGLFSYGRYKNSISRSTGADEYAEGSVNGTLMQLGALGGVNVPFAATGDLTVEGGLRHDLLKQDAFAEKGSALGWSGNSLTEGTLVGLAGLKLSQPLSDKAVLSATAGVERDLNGRDYAVTGGFTGAAAATGKTGARNMPHTRRVAGLGVDVEFGNGWNGLARYSYTGSKQYGNHSGQIGVGYRF

SEQ ID NO: 797 - protein, 454 aa, Neisseria
MSARGKGAGYLNSTGRRVPFLSAAKIGQDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNSLAATVYADSTAAHADMQGRRLKAVSDGLDHNGTGLRVIAQTQQDGGTWEQGGVEGKMRGSTQTVGIAAKTGENTTAAATLGMGRSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSLTEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 798 - protein, 454 aa, Neisseria
MSAGGKGAGYLNRTGQRVPFLSAAKIGRDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNNLAATVYADSTAAHADMQGRRLKAVSDGLDHNATGLRVIAQTQQDGGTWEQGGVEGKMRGSTQTVGIAAKTGENTTAAATLGMGHSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSITEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 799 - protein, 558 aa, Neisseria
MSFKTDAETAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERFGNILVAYAKDGSPVYAKDLKAHGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLEALAKGLPNLLKHISNLKNVFGLPVVVALNRFVSDSDAELAMIEKACAEHGVEVSLTEVWGKGGAGGADLARKVVNAIDNQPNNFGFAYDVELGIKDKIRAIAQKVYGAEDVDFSAEASAEIASLEKLGLDKMPICMAKTQYSLSDNAKLLGCPEGFRIAVRGITVSAGAGFIVALCGNMMKMPGLPKVPAAEKIDVDEHGVIHGLF

SEQ ID NO: 800 - protein, 558 aa, Neisseria
MSFKTDAEIAQSSTMRPIGEIAAKLGLNADNIEPYGHYKAKINPAEAFKLPQKQGRLILVTAINPTPAGEGKTTVTIGLADALRHIGKDAVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDADAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 801 - protein, 558 aa, Neisseria
MSFKTDAEIAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDSDAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 802 - protein, 158 aa, Neisseria
MRADFMFADNMPVQVRQRAFYFKLSRFAAMPNMVGKPLFGRQAGQPGKMFGNILMFVRQHIDAEAAVFRQDRNDSRTPVYAQHHGRRLVGNRRNRRHCNAVTPCRTVCRDDMNACRTGCHRITERSLKSFLQIRHFSPLNRPLYKNAAHKASPHVQQF

SEQ ID NO: 803 - protein, 158 aa, Neisseria
MRADFMFADNMPVQVRQRALYFKLSRFAAMPDVVGKPLFGRQAGQPGKMFGNILMFVRQRIDAEAAVFRQDRNDSRTPVDAQHHGRRLVGNRRDRRHCNAVTPCRTVCRDDMNACRARCHRITERSLKIFLQIRHFSPLNCPLYKNAAHKASPHVQQF

SEQ ID NO: 804 - protein, 315 aa, Neisseria
MRADFMFADNMPVQVRQRALYFKLSRFAAMPDVVGKPLFGRQAGQPGKMFGNILMFVRQRIDAEAAVFRQDRNDSRTPVDAQHHGRRLVRNRRNRRHCNAVTPCRTVCRDDMNACRTGCHRITERSLKSFLQIRHFSPLNCPLYKNAAHKAPPMCSSSDSKSRRSDISARYGVLRVQRILDFGKFCQQVFKQQHFLAAQHFLDSVVTLVHFFADFLIQLLALGSQLQKNTSLVVGRFQADNQTRFFKAGQDTGQAGAQNARLIRQILKVQRAVFRQKTDNPPLLIGNIRLIQNRPELGHQGFPCLYQTDIDRRMF

SEQ ID NO: 805 - protein, 428 aa, Neisseria
MLSFGYLGVQTAFTLQSSQMSRIFQTLGADPHNLGWFFILPPLAGMLVQPIVGYYSDRTWKPRLGGRRLPYLLYGTLIAVIVMILMPNSGSFGFGYASLAALSFGALMIALLDVSSNMAMQPFKMMVGDMVNEEQKSYAYGIQSFLANTDAVVAAILPFVFAYIGLANTAEKGVVPQTVVVAFYVGAALLIITSAFTISKVKEYDPETYARYHGIDVAANQEKANWFELLKTAPKVFWTVTPVQFFCWFAFRYMWTYSAGAIAENVWHTTDASSVGHQEAGNRYGVLAAVSVAAVICSFILAKVPNKYHKAGYFGCLALGALGFFSIFFIYNQYALILSYILIGIAWAGIITYPLTIVANALSGKHMDTYLGLFNGSVCMPQIVASLLSFVLFPMLGGHQATMFLVAGAVLLLGAFSVCLIKEIHGGV

SEQ ID NO: 806 - protein, 429 aa, Neisseria
MLSFGFLGVQTAFTLQSSQMSRIFQTLGADPHNLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYDPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 807 - protein, 429 aa, Neisseria
MLSFGFLGVQTAFTLQSSQMSRIFQTLGADPHSLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYNPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 808 - protein, 203 aa, Neisseria
MSDTPATRDFGLIDGRAVTGYVLSNRRGTCVFVLDLGGIVQEFSVLADGVRENPVVSFDDAASYADNPFQINKQIGRVAGRIRGAAFDINGRTYRVEANEGRNALHGGSHGLAVTRFNAVAADGRRLSQRFGYFLPLGRGRPAYRYLSRHRARRHGVRPDAAHLLAAGRGPARCGSAYSAGRTYSGRCRKTARLNGFRRPRSI

SEQ ID NO: 809 - protein, 218 aa, Neisseria
MSDTPATRDFGLIDGRAVTGYVLSNRRGTRVCVLDLGGIVQEFSVLADGVRENLVVSFDDAASYADNPFQINKQIGRVAGRIRGAAFDINGRTYRVEANEGRNALHGGSHGLAVTRFNAVAADGRSVVLRSRLATVGRRLSQRFGFGYFLPLGRGRPAYRYLSRHRARRHGVRPDAAHLLAAGRGPARCGSAYSAGRTYAGRCRKTARLNGFRRPRSI

SEQ ID NO: 810 - protein, 218 aa, Neisseria
  VARIANT (1)...(218): Xaa = Any Amino Acid
MSDTPATRDFGLIDGRAVTGYVLSNRRGTRVCVLDLGGIVQEFSVLADGVRENLVVSFDDAASYADNPFQINKQIGRVAGRIRGAAFDINGRTYRVEANEGRNALHGGSHGLAVTRFNAVAADGRSVVLRSRLXTVGRRLSQRFGFGYFLPLGRGRPAYRYLSRHRARRHGVRPDAAHLLAAGRGPARCGSAYSAGRTYSGRCRKTARLNGFRRPRSI

SEQ ID NO: 811 - protein, 212 aa, Neisseria
MKQIPLRLLQVVIDHDKVEQYGLFDFMPCLRQPPLDNFPTVRPAPFEARGKHVERRRQDKDTDSFRQRVANLRRALNVDFQNHVIACRRQRIHALRACAVIVAEYVCVFQKSLLRDKRFKLFFGNKVIMYAVCFAFTRRARRMRHGNAQTVMVCQQPRHQRGFARAGSGRNDKDVAFSISGHIFYLYIFQPIVSQRTPYFIFADAHILPLLF

SEQ ID NO: 812 - protein, 212 aa, Neisseria
MAQILLRSRQVVIDHDKVKQYGLLDFMPCLRQPPLDNFPTVRPASVEARGKYVERRRQDKDADGFGQRVANLRRALNVDFQNHVIACRRQRIHTLRACAVIVAKYVGVFQKSFLRDKRLKLFFGNKVIMYAVCFAFTRRARRVRHGNAQTVMVCQQPRHQRGFARAGSGRNDKDVAFSISGHIFYLYIFQPIVSQWTPSFLFADAHILPLLF

SEQ ID NO: 813 - protein, 212 aa, Neisseria
MAQILLRPRQVIIDHDKIEQYGLFDFMPCLRQPPLDNFPTVRPASVETRSKHIERRRQDKDADGFGQRISNLSRALNVDFQNHVITCRRQRIHTLRACAVIVAEHVRVFQKSLLRDKRLKLFFGNKVIMYAVCFAFTRRTRRVRHGNAQTVMVCQQPRHQRGFARAGSGRNDKDVAFSISGHIFYLYIFQPIVSQRTPGFLFADAHILPLLF

SEQ ID NO: 814 - protein, 174 aa, Neisseria
MRREAKMAQITLKPIVLSILLINTPLLAQAHETEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGAGQCCRWKNPPKNA

SEQ ID NO: 815 - protein, 735 aa, Neisseria
PHKTEQSVDLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGVAYSDRRDQYGLPAHSHEYDDCHADIIWQKSLINKRYLQLYPHLLTEEDIDYDNPGLSCGFHDDDNAHAHTHSGRPWIDLRNKRYELRAEWKQPFPGFEALRVHLNRNDYRHDEKAGDAVENFFNNQTQNARIELRHQPIGRLKGSWGVQYLQQKSSALSAISEAVKQPMLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 816 - protein, 764 aa, Neisseria
MRREAKMAQTTLKPIVLSILLINTPLLSQAHGTEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDSALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGAAYSDRRDQYGLPAHSHEYDDCHADIIWQKSLINKRYLQLYPHLLTEEDIDYDNPGLSCGFHDDDDAHAHAHNGKPWIDLRNKRYELRAEWKQPFPGFEALRVHLNRNDYRHDEKAGDAVENFFNNQTQNARIELRHQPIGRLKGSWGVQYLGQKSSALSATSEAVKQPMLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 817 - protein, 199 aa, Neisseria
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKPGSRVLLVDDLVATGGTMLAGLELIRKLGGEIVEAAAILEFTDLQGGKNIRASGAPLFTLLQNEGCMKG

SEQ ID NO: 818 - protein, 199 aa, Neisseria
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLIATGGTMLAGLELIRKLGGEIVEAAAILEFTDLQGGKNIRASGAPLFTLLQNEGCMKG

SEQ ID NO: 819 - protein, 199 aa, Neisseria
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLVATGGTMLAGLELIRKLGGEIVEAAAILEFTDLQGGKNIRASGAPLFTLLQNEGCMKG

SEQ ID NO: 820 - protein, 339 aa, Neisseria
MLIDNNVRHYSFFGVEQANWDNFTLEGGVRVEKQKASIRYDKALIDRENYYNQPLPDLGAHRQTARSFALSGNWYFTPHHKLSLTASHQERLPSTQELYAHGKHVATNTFEVGNKHLNKERSNNIELALGYKGDRWQYNLAAYRNRFGNYIYAQTLNDGRGPKSIEDDSEMKLVRYNQSGADFYGAEGEIYFKPTPRYRIGVSGDYVRGRLKNLPSLPGREDPYGKRPFIAQADQNAPRIPAARLGFHLKTSLTDRIDANLDYYRVFAQNKLARYETRTPGHHMLNLGANYRRNTRYGEWNWYVKADNLLNQSVYAHSSFLSDTPQMGRSFAGGVNVKF

SEQ ID NO: 821 - protein, 339 aa, Neisseria
MLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 822 - protein, 339 aa, Neisseria
MLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 823 - protein, 758 aa, Neisseria
MAQITLKPIVLSILLINTPLLAQAHETEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGEAGLRLSSGNLEKLTSAGINIGLGKNFVLHTEGLYRKSGDYAVPRYRNLKRLPDSHADSQTGSIGLSWVGEKGFIGAAYSDRRDRYGLPAHSHEYDDCHADIIWQKSLINKRYLQLYPHLLTEEDIDYDNPGLSCGFHDGDGAHAHTHNGKPWIDLRNKRYELRAEWKQPFPGFEALRVHLNRNDYHHDEKAGDAVENFFNNKTHNARIELRHQPIGRLKGSWGVQYLGQKSSALSAIPETVQQPMLIDNNVRHYSFFGVEQANWDNFTLEGGVRVEKQKASIRYDKALIDRENYYNQPLPDLGAHRQTARSFALSGNWYFTPHHKLSLTASHQERLPSTQELYAHGKHVATNTFEVGNKHLNKERSNNIELALGYEGDRWQYNLAAYRNRFGNYIYAQTLNDGRGPKSIEDDSEMKLVRYNQSGADFYGAEGEIYFKPTPRYRIGVSGDYVRGRLKNLPSLPGREDPYGKRPFIAQADQNAPRIPAARLGFHLKTSLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 824 - protein, 758 aa, Neisseria
MAQTTLKPIVLSILLINTPLLAQAHETEQSVDLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGVAYSDRRDQYGLPAHSHEYDDCHADIIWQKSLINKRYLQLYPHLLTEEDIDYDNPGLSCGFHDDDNAHAHTHSGRPWIDLRNKRYELRAEWKQPFPGFEALRVHLNRNDYRHDEKAGDAVENFFNNQTQNARIELRHQPIGRLKGSWGVQYLQQKSSALSAISEAVKQPMLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 825 - protein, 758 aa, Neisseria
MAQTTLKPIVLSILLINTPLLSQAHGTEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDSALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGAAYSDRRDQYGLPAHSHEYDDCHADIIWQKSLINKRYLQLYPHLLTEEDIDYDNPGLSCGFHDDDDAHAHAHNGKPWIDLRNKRYELRAEWKQPFPGFEALRVHLNRNDYRHDEKAGDAVENFFNNQTQNARIELRHQPIGRLKGSWGVQYLGQKSSALSATSEAVKQPMLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 826 - protein, 369 aa, Neisseria
YCKADPFPAALLANQKITARQSDKDVRHIEIDLSGSDLHYLPGDALGVWFDNDPALVGEILDLLGINPATEIQAGGKTLPVASALLSHFELTQNTPAFVKGYATFADNDELDRIAADNAVLQGFVQSTPIAGVLHRFPAKLTAEQFAGLLRPLAPRLYSISSSQAEAGDEVHLTVGAVRFEHEGRARAGGASGFFADRLEEDGTVRVFAERNDGFRLPEDSRKPIVMIGSGTGVAPFRAFVQQRAAENAEGRNWLIFGNPHFAADFLYQTEWQQFAKDGFLHRYDFAWSRDQEEKIYVQDKIREQAEGLWQWLQEGAHIYVCGDAAKMAKEVEAALLDVIIGAGHSDEDGAEGYLDMLREEKRYQRDVY

SEQ ID NO: 827 - protein, 599 aa, Neisseria
MQNTNPPLPPLPPEITQLLSGLDAAQWAWLSGYAWAKAGNGASAGLPALQTALPAAEPFSVTVLSASQTGNAKSVADKAADSLEAAGIQVSRAELKDYKAKNIAGERRLLLVTSTQGEGEPPKEAVVLHKLLNGKKAPKLDKLQFAVLGLGDSSYPNFCQAGKDFDRRFEELGAKRLLERVDADLDFTASANAWTDNIAALLKEEAAKNRATPAPQTTPPAGLQTAPDGRYCKAAPFPAALLANQKITARQSDKDVRHIEIDLSGSDLHYLPGDALGVWFDNDPALVREILDLLGIDPATEIQAGGKMMPVARALSSHFELTQNTPAFVKGYAAFAHYEELDKIIADNAVLQDFVQNTPIVDVLHRFPASLTAEQFIRLLRPLAPRLYSISSAQAEVGDEVHLTVGVVRFEHEGRARTGGASGFLADRLEEDGTVRVFVERNDGFRLPEDSRKPIVMIGSGTGVAPFRAFVQQRAAENAEGKNWLIFGNPHFARDFLYQTEWQQFAKDGFLHRYDFAWSRDQEEKIYVQDKIREQAEGLWQWLQEGAHIYVCGDAAKMAKDVEAALLDVIIGAGHLDEEGAEEYLDMLREEKRYQRDVY

SEQ ID NO: 828 - protein, 599 aa, Neisseria
MQNTNPPLPPMPPEITQLLSGLDAAQWAWLSGYAWAKAGNGASAGLPALQTALPTAEPFSVTVLSASQTGNAKSVADKAADSLEAAGIQVSRAELKDYKAKNIAGERRLLLVTSTQGEGEPPEEAVVLHKLLNGKKAPKLDKLQFAVLGLGDSSYPNFCRAGKDFDKRFEELGAKRLLERVDADLDFAAAADGWTDNIAALLKEEAAKNRATPAPQTTPPAGLQTAPDGRYCKADPFPAALLANQKITARQSDKDVRHIEIDLSGSDLHYLPGDALGVWFDNDPALVREILDLLGIDQATEIQAGGKTLPVASALLSHFELTQNTPAFVKGYAPFADDDELDRIAADNAVLQGFVQSTPIADVLHRFPAKLTAEQFAGLLRPLAPRLYSISSSQAEVGDEVHLTVGAVRFEHEGRARAGGASGFLADRLEEDGTVRVFVERNDGFRLPEDSRKPIVMIGSGTGVAPFRAFVQQRAAENAEGKNWLFFGNPHFARDFLYQTEWQQFAKDGFLHRYDFAWSRDQEEKIYVQDKIREQAEGLWQWLQEGAHIYVCGDAAKMAKDVEAALLDVIIGAGHLDEEGAEEYLDMLREEKRYQRDVY

SEQ ID NO: 829 - protein, 603 aa, Neisseria
MKQIRNIAIIAHVDHGKTTLVDQLLRQSGTFRANQQVDERVMDSNDLEKERGITILAKNTAIDYEGCHINIVDTPGHADFGGEVERVLGMVDCVVLLVDAQEGPMPQTRFVTKKALALGLKPIVVINKIDKPSARPSWVIDQTFELFDNLGATDEQLDFPIVYASGLSGFAKLEETDESSDMRPLFDTILKYTPAPSGSADEPLQLQISQLDYDNYTGRLGIGRILNGRIKPGQTVAVMNHEQQIAQGRINQLLGFKGLERVPLEEAEAGDIVIISGIEDIGIGVTITDKDNPKGLPMLSVDEPTLTMDFMVNTSPLAGTEGKFVTSRQIRDRLQKELLTNVALRVEDTADADVFRVSGRGELHLTILLENMRREGYELAVGKPRVVYRDIDGQKCEPYENLTVDVPDDNQGAVMEELGRRRGELTNMESDGNGRTRLEYHIPARGLIGFQGEFMTLTRGVGLMSHVFDDYAPVKPDMPGRHNGVLVSQEQGEAVAYALWNLEDRGRMFVSPNDKIYEGMIIGIHSRDNDLVVNPLKGKKLTNIRASGTDEAVRLTTPIKLTLEGAVEFIDDDELVEITPQSIRLRMRYLSELERRRHFKKLD

SEQ ID NO: 830 - protein, 603 aa, Neisseria
MKQIRNIAIIAHVDHGKTTLVDQLLRQSGTFRANQQVDERVMDSNDLEKERGITILAKNTAIDYEGYHINIVDTPGHADFGGEVERVLGMVDCVVLLVDAQEGPMPQTRFVTKKALALGLKPIVVINKIDKPSARPSWVIDQTFELFDNLGATDEQLDFPIVYASGLSGFAKLEETDESNDMRPLFDTILKYTPAPSGSADETLQLQISQLDYDNYTGRLGIGRILNGRIKPGQTVAVMNHDQQIAQGRINQLLGFKGLERVPLEEAEAGDIVIISGIEDIGIGVTITDKDNPKGLPMLSVDEPTLTMDFMVNTSPLAGTEGKFVTSRQIRDRLQKELLTNVALRVEDTADADVFRVSGRGELHLTILLENMRREGYELAVGKPRVVYRDIDGQKCEPYENLTVDVPDDNQGAVMEELGRRRGELTNMESDGNGRTRLEYHIPARGLIGFQGEFMTLTRGVGLMSHVFDDYAPVKPDMPGRHNGVLVSQEQGEAVAYALWNLEDRGRMFVSPNDKIYEGMIIGIHSRDNDLVVNPLKGKKLTNIRASGTDEAVRLTTPIKLTLEGAVEFIDDDELVEITPQSIRLRKRYLSELERRRHFKKLD

SEQ ID NO: 831 - protein, 603 aa, Neisseria
MKQIRNIAIIAHVDHGKTTLVDQLLRQSGTFRANQQVDERVMDSNDLEKERGITILAKNTAIDYEGYHINIVDTPGHADFGGEVERVLGMVDCVVLLVDAQEGPMPQTRFVTKKALALGLKPIVVINKIDKPSARPSWVIDQTFELFDNLGATDEQLDFPIVYASGLSGFAKLEETDESNDMRPLFDTILKYTPAPSGSADETLQLQISQLDYDNYTGRLGIGRILNGRIKPGQVVAVMNHDQQIAQGRINQLLGFKGLERVPLEEAEAGDIVIISGIEDIGIGVTITDKDNPKGLPMLSVDEPTLTMDFMVNTSPLAGTEGKFVTSRQIRDRLQKELLTNVALRVEDTADADVFRVSGRGELHLTILLENMRREGYELAVGKPRVVYRDIDGQKCEPYENLTVDVPDDNQGAVMEELGRRRGELTNMESDGNGRTRLEYHIPARGLIGFQGEFMTLTRGVGLMSHVFDDYAPVKPDMPGRHNGVLVSQEQGEAVAYALWNLEDRGRMFVSPNDKIYEGMIIGIHSRDNDLVVNPLKGKKLTNIRASGTDEAVRLTTPIKLTLEGAVEFIDDDELVEITPQSIRLRKRYLSELERRRHFKKLD

SEQ ID NO: 832 - protein, 218 aa, Neisseria
MKNKTKVWDFPTRLFHWLLAASLPFMWYSAKAGGDMLQWHTRVGLLVLFLLVFRLCWGIWGSDTARFSRFVRGWAGIRGYLKNGIPEHIQPGHNPLGALMVVALLAAVSFQVGTGLFAANENTFSTNGYLNHLVSEHTGSLIRKIHLNFFKLLAVFSAVHIAAVAAYRIFKKKNLVRPMITGFKYIEGKTSIRFAGKAALAAALSVAALAAAAILLLS

SEQ ID NO: 833 - protein, 218 aa, Neisseria
MKNKTKVWDLPTRLFHWLLAASLPFMWYSAKAGGDMLQWHTRVGLFVLFLLVFRLCWGIWGSDTARFSRFVQGWAGIRGYLKNGIPEHIQPGHNPLGALMVVALLAAVSFQVGTGLFAADENTFSTNGYLNHLVSEHTGSLMRKIHLNFFKLLAVFSAIHIAAVAAYRVFKKKNLILPMITGFKYIEGKTSIRFAGKAALAAALSVASLAAAAILLLS

SEQ ID NO: 834 - protein, 218 aa, Neisseria
  VARIANT (1)...(218): Xaa = Any Amino Acid
MKNKTKVWDFPTRLFHWLLAASLPFMWYSAKTGGDMLQWHTRVGLFILFLLVFRLCWGIWGSDTARFSRFVRGWSGIREYMKNGIPEHVQPGHNPLGALMVVALLAAVSFQVGTGLFAADVNTFSTNGYLNHLVSEHTGSLMRKIHLNFFKLLAVFSAVHIAXVAAYRVFKKKNLVLPMITGFKYIEGKTSIRFAGKAALAAALSVAALAAAAILLLS

SEQ ID NO: 835 - protein, 358 aa, Neisseria
MGFAYSMTYIEVGIPEAASVLSLPEMMRLMVFQDYGFLAEVMFVLTFGAPVLFLLLCLYVYAALIRKQAYPALRLATRVMVRLRQAMMVDVFFVSTLVAYIKLSSVAKVRFGPAFYLMFALSVMLIRTSVSVPQHWVYFQIGRLTGNNAVQTASEGKTCCSRCLYFRDSAESPCGVCGAELYGGRPKSLSISSAFLTAAVVLYFPANILPIMISSNPAATEANTIFSGIAYMWDEGDRLIAAVIFSASILVPVLKIAAMSVLIAAARFALPAGAKKLSHLYRITEAVGRWSMIDIFVIIILMCSFHTYAARVIPGSAAVYFCLVVILTMLSAYYFDPRLLWDKRASDGIAFNETEKYD

SEQ ID NO: 836 - protein, 358 aa, Neisseria
MAFAYGMTYIEVGIPGAASVLSLPEMMRLMVFQDYGFLAEVMFVLTFGAPVLFLLLCLYVYAALIRKQAYPALRLATRVMVRLRQAMMVDVFFVSTLVAYIKLSSVAEVRFGPAFYLMFALSVMLIRTSVSVPQHWVYFQIGRLTGDNAVQTASEGKTCCSRCLYFRDSAESPCGVCGAELYRRRPKSLSISSAFLTAAVILYFPANILPIMISSNPAATEVNTILNGIAYMWDEGDRLIAAVIFSASILVPVLKIAAMSVLIASARFALPTGAKKLSHLYRITEAVGRWSMIDIFVIIILMCSFHTYAARVIPGSAAVYFCLVVILTMLSAYYFDPRLLWDKRASDGIAFNETEKHD

SEQ ID NO: 837 - protein, 358 aa, Neisseria
MAFAYGMTYIEVGIPGAASVLSLPEMMRLMVFQDYGFLAEVMFVLTFGAPVLFLLLCLYVYAALIRKQAYPALRLATRVMVRLRQAMMVDVFFVSTLVAYIKLSSVAEVRFGSAFYLMFALSVMLIRTSVSVPQHWVYFQIGRLTGDNAVQTASEGKTCCSRCLYFRDSAESPCGVCGAELYRRRPKSLSISSAFLTAAVILYFPANILPIMISSNPAATEVNTILNGIAYMWDEGDRLIAAVIFSASILVPVLKIAAMSVLIASARFALPTGAKKLSHLYRITEAVGRWSMIDIFVIIILMCSFHTYAARVIPGSAAVYFCLVVILTMLSAYYFDPRLLWDKRASDGIAFNETEKHD

SEQ ID NO: 838 - protein, 553 aa, Neisseria
MTDNSPPPNGHAQARVRKNNTFLSAVWLVPLIALIAGGWLWVKEIRNRGPVVTLLMDSAEGIEVNNTVIKVLSIDVGRVTRIKLRDDQKGVEVTAQLNADVSGLIRSDTQFWVVKPRIDQSGVTGLGTLLSGSYIAFTPGKSGEAKDVFQVQDIPPVTAIGQSGLRLNLIGKNDRILNVNSPVLYENFMVGQIESAHFDPSDQSVHYTIFIQSPNDKLIHSASRFWLESGINIETTGSGIKLNSAPLPALLSGAISFDSPKTKNSKNVKSEDSFTLYDSRSEIANLPDDRSLYYTAFFKQSVRGLTVGSPVEYKGLNVGMVSDVPYFDRNDSLHLFENGWIPVRIRIEPSRLEINADEQSKEHWKQQFQTALNKGLTATISSNNLLTGGKMIELNDQPSASPKLRPHTVYAGDTVIATRGGGLDDLQVKLADLLDKFNNLPLDKTVAELNGSLAELKSALKSANAALSSIDKLVGNPQTQNIPNELNQTLKELRITLQGVSPQSPIYGDVQNTLQSLDKTLKDVQPVINTLKEKPNALIFNNSSKDPIPKGSR

SEQ ID NO: 839 - protein, 553 aa, Neisseria
MTDNSPPPNGHAQARVRKNNTFLSAVWLVPLIALIAGGWLWVKEIRNRGPVVTLLMDSAEGIEVNNTVIKVLSIDVGRVTRIKLRDDQKGVEVTAQLNADVSGLIRSDTQFWVVKPRIDQSGVTGLGTLLSGSYIAFTPGKSDEAKDVFQVQDIPPVTAIGQSGLRLNLIGKNDRILNVNSPVLYENFMVGQVESAHFDPSDQSVHYTIFIQSPNDKLIHSASRFWLESGINIETTGSGIKLNSAPLPALLSGAISFDSPKTKNSKNVKSEDSFTLYDSRSEVANLPDDRSLYYTAFFKQSVRGLTVGSPVEYKGLNVGVVSDVPYFDRNDSLHLFENGWIPVRIRIEPSRLEINADEQSKEHWKQQFQTALNKGLTATISSNNLLTGSKMIELNDQPSASPKLRPHTVYAGDTVIATQGGGLDDLQVKLADLLDKFDKLPLDKTVAELNGSLAELKSTLKSANAALSSIDKLVGKPQTQNIPNELNQTLKELRTTLQGVSPQSPIYGDVQNTLQSLDKTLKDVQPVINTLKEKPNALIFNSSSKDPIPKGSR

SEQ ID NO: 840 - protein, 553 aa, Neisseria; identical to SEQ ID NO: 839

SEQ ID NO: 841 - protein, 512 aa, Neisseria
MKIGIPRESLSGETRVACTPATVALLGKLGFETVVESGAGLAASLDDAAYQTAGATVADKAAVWACPLIYKVNAPSEGELPLLKEGQTIVSFLWPRQNEALVEALRAKKVNALAMDMVPRISRAQALDALSSMANISGYRAVIEAANAFGRFFTGQITAAGKVPPAQVLVIGAGVAGLAAIGTANSLGAVVRAFDTRLEVAEQIESMGGKFLKLDFLQESGGSGDGYAKVMSDEFIAAEMKLFAEQAKEVDIIITTAAIPGKPAPKLITKEMVESMKSGSVIVDLAATGGNCELTRPGELSVTGNGVKIIGYTDMANRLAGQSSQLYATNLVNLTKLLSPNKDGEITLDFEDVIIRNMTVTRDGEITFPPPPIQVSARPQQTPSEKAAPAAKPEPKPVPLWKKLAPAAIAAVLVLWVGAVAPAAFLNHFIVFVLACVIGYHVVWNVSHSLHTPLMSVTNAISGIMVVGALLQIGQGNGFVSLLSFVAILIAGINIFGGFAVTRRMLNMFKKG

SEQ ID NO: 842 - protein, 513 aa, Neisseria
MKIGIPRESLSGETRVACTPATVALLGKLGFETVVESGAGLAASLDDAAYQTAGATVADKAAVWVCPLIYKVNAPSEQELPLLNEGQTIVSFLWPRQNEALVEALRAKKVNALAMDMVPRISRAQALDALSSMANISGYRAVIEAANAFGRFFTGQITAAGKVPPAQVLVIGAGVAGLAAIGTANSLGAVVRAFDTRLEVAEQIESMGGKFLKLDFPQESGGSGDGYAKVMSDEFIAAEMKLFAEQAKEVDIIITTAAIPGKPAPKLITKEMVESMKSGSVIVDLAAATGGNCELTRPGELSVTGNGVKIIGYTDMANRLAGQSSQLYATNLVNLTKLLSPNKDGEITLDFEDVIIRNMTVTHDGEITFPPPPIQVSAQPQQTPSEKAVPAAKPEPKPVPLWKKLAPAVIAAVLVLWVGAVAPAAFLNHFIVFVLACVIGYYVVWNVSHSLHTPLMSVTNAISGIIVVGALLQIGQGNGFVSLLSFVAILIAGINIFGGFAVTRRMLNMFKKG

SEQ ID NO: 843 - protein, 513 aa, Neisseria
  VARIANT (1)...(513): Xaa = Any Amino Acid
MKIGIPRESLSGETRVACTPATVALLGKLGFETVVESGAGLAASLDDAAYQAAGATVADKAAVWAYPLIYKVNAPSEDELPLLKEGQTIVSFLWPRQNEALVEALRAKKVNALAMDMVPRISRAQALDXLSXMANISGYRAVIEAANAFGRXFTGQITAAGKVPPAQVLVIGAGVAGLAAIGTANSLGAVVRVFDTRLXVAEQLESMGGKFLKLDFPQESGGSGDGYAKVMSDEFIAAEMKLFAEQAKEVDIIITTAAIPGKPAPKXXXKEMVESMKPGSVIVDLAAATGGNCELTKQGELFVTGNGVKIIGYTDMANRLAGQSSQLYATNLVNLTKLLSPNKDGEITLDFEDVIIRNMTVTRDGEITFPPPPIQVSAQPQQTPSEKAAPAAKPEPKPVPLWKKLAPAXIAAVLVLWVGAVAPAAFLNHFIVFVLACVIGYYVVWNVSHSLHTPLMSVTNAISGIIVVGALLQIGQGNGFVSLLSFVAILIASINIFGGFFVTRRMLNMFRKG

SEQ ID NO: 844 - protein, 127 aa, Neisseria
MTFAYWCILIACLLPLFCAAYAKKAGGFRFKDNHNPRGFLAHTQGAAARAHAAQQNGFEAFAPFAAAVLTAHATGNAGQATVNTLAGLFILFRLAFIWCYIADKAALRSLMWAGGFACTVGLFVAAA

SEQ ID NO: 845 - protein, 127 aa, Neisseria
MTFAYWCILIACLLPLFCAAYAKKAGGFRFKDNHNPRGFLAHTQGAAARAHAAQQNGFEAFAPFAAAVLTAHATGNAAQSTINTLACLFILFRLAFIWCYIADKAAMRSLMWAGGFACTVGLFVAAA

SEQ ID NO: 846 - protein, 127 aa, Neisseria
MTFAYWCILIAYLLPLFCAAYAKKAGGFRFKDNHNPRDFLARTQGTAARAHAAQQNGFEAFAPFAAAVLTAHATGNAGQATVNTLAGLFILFRLAFIWCYIADKAALRSLMWVGGFVCTVGLFVVAA

SEQ ID NO: 847 - protein, 193 aa, Neisseria
MRNEEKRALRRELRGRRSQMGRDVRAAAAIKINRLLKRYIKRGRKIGVYWPMGKELRLGGFVRAAQKRGAKLYLPYIEPHTRRMWFTPYPERGMERERKRGRAKLHVPQFAGRKIRVHGLSVLLVPLVGIDREGYRLGQAGGYYDATLSAMKYRLQAKTVGVGFACQLVDRLPREAHDLPLDGFVSEAGILCF

SEQ ID NO: 848 - protein, 193 aa, Neisseria
MRNEEKRALRRELRGRRSQMGRDVRAAATVKINHLLKRYIKKGRKIGVYWPMGKELRLDGFVRAAQKRGAELYLPYIEPRSRRMWFTPYPADGVKQERKRGRAKLHVPQFAGRKKRVHDLNLLLVPVVGMDRLGYRLGQAGGYYDATLSAMKYRLQAKTVGVGFACQLVDRLPVEAHDRSLDGFVSEAGILCF

SEQ ID NO: 849 - protein, 193 aa, Neisseria
MRNEEKHALRRELRRARAQMGHQGRLAAGQTINRLLKRYIKRGRKIGVYWPMGKELRLDGFVRAAQKRGAKLYLPYIEPRSRRMWFTPYPESGMERERIRGRAKLNVPQFAGRKIRVHGLSVLLVPLVGIDREGYRLGQAGGYYDATLAAMKYRLQAKTVGVGFACQFVDRLPREPHDLLLDGFVSEAGILCF

SEQ ID NO: 850 - protein, 303 aa, Neisseria
MKTNSEELTVFVQVVESGSFSRAAEQLEMANSAVSRIVKRLEEKLGVNLLNRTTRQLNLTEEGAQYFRRAQRILQEMAAAETEMLAVHEVPQGVLRVDSAMPMVLHLLAPLAAKFNERYPHIRLSLVSSEGYINLIERKVDIALRAGELDDSGLRARHLFDSHFRVVASPEYLAKHGTPQSAEDLANHQCLGFTEPGSLNTWAVLDAQGNPYKISPHFTASSGEILRSLCLSSCGIACLSDFLVDNDITEGKLIPLFAEQTSNKTHPFNAVYYSDKAVNLRLRVFLDFLVKELGKNMNRTNTK

SEQ ID NO: 851 - protein, 299 aa, Neisseria
MKTNSEELTVFVQVVESGSFSRAAEQLAMANSAVSRIVKRLEEKLGVNLLNRTTRQLSLTEEGAQYFRRAQRILQEMAAAETEMLAVHEIPQGVLSVDSAMPMVLHLLAPLAAKFNERYPHIRLSLVSSEGYINLIERKVDIALRAGELDDSGLRARHLFDSRFRVIASPEYLAKHGTPQSTEELAGHQCLGFTEPGSLNTWAVLDAQGNPYKISPHFTASSGEILRSLCLSGCGIVCLSDFLVDNDIAEGKLIPLLAEQTSDKTHPFNAVYYSDKAVNLRLRVFLDFLVEELGNNLCG

SEQ ID NO: 852 - protein, 299 aa, Neisseria
MKTNSEELTVFVQVVESGSFSRAAEQLAMANSAVSRIVKRLEEKLGVNLLNRTTRQLSLTEEGAQYFRRAQRILQEMAAAETEMLAVHEIPQGVLRVDSAMPMVLHLLAPLAAKFNERYPHIRLSLVSSEGYINLIERKVDIALRAGELDDSGLRARHLFDSRFRVIASPEYLAKHGTPQSTEELAGHQCLGFTEPGSLNTWAVLDAQGNPYKISPHFTASSGEILRSLCLSGCGIACLSDFLVDNDIAEGKLIPLLAEQTSNKTHPFNAVYYSDKAVNLRLRVFLDFLVEELGNNLCG

SEQ ID NO: 853 - protein, 298 aa, Neisseria
MDILDKLVDLAQLTGSADVQCLLGGQWHETLQREGLVHIVTAGSGYLCIDGETSPRPVGTGDIVFFPRGLGHVLSHDGKYGESLQPDIRQNGTFMVKQCGNGLDMSLFCARFRYDTHADLMNGLPETVFLNIAHPSLQYVVSMLQLESEKPLTGTVSVVNALPSVLLVLILRAYLEQDKDVELSGVLKGWQDKRLGHLIQKVIDKPEDEWNIDKMVAAANMSRAQLMRRFKSQVGLSPHAFVNHIRLQKGALLLKKTPDSVLEVALSVGFQSETHFGKAFKRQYHVSPGQYRKEGGQK

SEQ ID NO: 854 - protein, 301 aa, Neisseria
MDILDKLVDFAQLTGSVDVQCLLGGQWSVRHETLQREGLVHIVTSGSGYLCIDGETSPRPVSTGDIVFFPRGLGHVLSHDGKCGESLQPDMRQHGAFTVKQCGNGQDMSLFCARFRYDTHADLMNGLPETVFLNIAHPSLQYVVSMLQLESKKPLTGTVSMVNALSSVLLVLILRAYLEQDKDVELSGVLKGWQDKRLGHLIQKVIDKPEDEWNVDKMVAAANMSRAQLMRRFKSRVGLSPHAFVNHIRLQKGALLLKKNPDSVLSVALSVGFQSETHFGKAFKRQYHVSPGQYRKEGGQK

SEQ ID NO: 855 - protein, 301 aa, Neisseria; identical to SEQ ID NO: 854

SEQ ID NO: 856 - protein, 300 aa, Neisseria; identical to SEQ ID NO: 305

SEQ ID NO: 857 - protein, 300 aa, Neisseria; identical to SEQ ID NO: 302
  VARIANT (1)...(300): Xaa = Any Amino Acid

SEQ ID NO: 858 - protein, 300 aa, Neisseria; identical to SEQ ID NO: 303

SEQ ID NO: 859 - protein, 660 aa, Neisseria
MVILTTLFFVCVLVVLVLTVPDQVQMWLDRAKEVIFTEFSWFYVLTFSIFLGFLLILSVSGLGNIRLGRDEDVPEFGFLSWLAMLFAAGMGVGLMFFGVAEPLMHYFSDITVGAPEHRQQQALLHTVFHWGVHAWSVYGTIALALAYFGFRYKLPLALRSCFYPLLKEKISGRFGDAIDIMALLATFFGIITTLGFGASQLGAGLQEMGWIAENSFGVQVLIIAAVMSLAVVSAISGVGKGVKVLSELNLGLAFLLLFFVLAADPTVYLLSAFGDNIGNYLGNLVRLSLKTYAYEREHKPWFESWTVLYWAWWCSWAPFVGLFIARISKGRTIREFVFGVLLIPGLFGVLWFTVFGNTAIWLNDGVAGGMLEKMTSSPETLLFKFFNYLPLPELTSIVSLLVISLFFVTSADSGIYVLNNITSRDKGLSAPRWQAVMWGVLMSAVAVLLMRSGGLGNLQSMTLIVSLPFALLMLIMCFSLWKGLSADKKYFETRVNPTSVFWTGGKWKERLVRIMSQTQEQDILKFLKHTASPAMHELQRELSEEYGLSVRVDKMFHQDEPAIEFVIRKETMRDFMYGIKSVGQDVSDQLINDGKLPHIRHQTTYKPYAYFFDGRVGYDVQYMNKDELIADILKNYERYLMLLDDVGQELMAHEQVELAE

SEQ ID NO: 860 - protein, 660 aa, Neisseria
MVILTTLFFVCVLVVLVLTVPDQVQMWLDRAKEVIFTEFSWFYVLTFSIFLGFLLILSVSSLGNIRLGRDEDVPEFGFLSWLAMLFAAGMGVGLMFFGVAEPLMHYFSDITAGTPEHRQQQALLHTVFHWGVHAWSVYGTIALALAYFGFRYKLPLALRSCFYPLLKEKISGRFGDAIDIMALLATFFGIITTLGFGASQLGAGLQEMGWIAENSFSVQVLIIAAVMSLAVVSAISGVGKGVKVLSELNLGLAFLLLFFVLAAGPTVYLLSAFGDNIGNYLGNLVRLSFKTYAYEREHKPWFESWTVLYWAWWCSWAPFVGLFIARISKGRTIREFVFGVLLIPGLFGVLWFTVFGNTAIWLNDGVAGGMLEKMTSSPETLLFKFFNYLPLPELTSIVSLLVISLFFVTSADSGIYVLNNITSRDKGLSAPRWQAVMWGVLMSAVAVLLMRSGGLGNLQSMTLIVSLPFALLMLIMCFSLWKGLSADKKYFETRVNPTSVFWTGGKWKERLVQIMSQTQEQDILKFLKQTASPAMHELQRELSEEYGLSVRVDKMFHRDEPAIEFVIRKETMRDFMYGIKSVGQDVSDQLINDGKLPHIRHQTTYKPYAYFFDGRVGYDVQYMNKDELIADILKNYERYLMLLDDVGQELMAHEQVELAE

SEQ ID NO: 861 - protein, 660 aa, Neisseria
MVILTTLFFVCVLVVLVLTVPDQVQMWLDRAKEVIFTEFSWFYVLTFSIFLGFLLILSVSSLGNIRLGRDEDVPEFGFLSWLAMLFAAGMGVGLMFFGVAEPLMHYFSDITAGTPEHRQQQALLHTVFHWGVHAWSVYGTIALALAYFGFRYKLPLALRSCFYPLLKEKISGRFGDAIDIMALLATFFGIITTLGFGASQLGAGLQEIGWIAENSFSVQVLIIAAVMSLAVVSAISGVGKGVKVLSELNLGLAFLLLFFVLAAGPTVYLLSAFGDNIGNYLGNLVRLSFKTYAYEREHKPWFESWTVLYWAWWCSWAPFVGLFIARISKGRTIREFVFGVLLIPGLFGVLWFTVFGNTAIWLNDGVAGGVLEKMTSSPETLLFKFFNYLPLPELTSIVSLLVISLFFVTSADSGIYVLNNITSRDKGLSAPRWQAVMWGVLMSAVAVLLMRSGGLGNLQSMTLIVSLPFALLMLIMCFSLWKGLSADKKYFETRVNPTSVFWTGGKWKERLVQIMSQTQEQDILKFLKHTASPAMHELQRELSEEYGLSVRVDKMFHQDEPAIEFVIRKETMRDFMYGIKSVGQDVSDQLINDGKLPHIRHQTTYKPYAYFFDGRVGYDVQYMNKDELIADILKNYERYLMLLDDVGQELMAHEQVELAE

SEQ ID NO: 862 - protein, 432 aa, Neisseria
MNTFLKNSEYAYILNDCKARFLFASAGLSKELAGLKAQTPVEKIIWTDKSRPAGETAEGDAFFENVRRFPEKPDLGRQPRINDLAHIIYTSGTTGHPKGALISYANLFANLNGIERIFKISKRDRFIVFLPMFHSFTLTAMVLLPIYMACSIILVKSVFPFSNVLKQALLKRATVFLGVPAIYTAMSKAKIPWYFRWFNRIRLFISGGAPLAEQTILDFKAKFPRAKLLEGYGLSEASPVVAVNTPERQKARSVGIPLPGLEAKAVDEELVEVPRGEVGELIVRGGSVMRGYLNMPAATDETIVNGWLKTGDFVTIDEDGFIFIVDRKKDLIISKGQNVYPREIEEEIHKLDAVEAAAVIGVKDRYADEEIVAFVQLKEGMDLGEDEIRRHLRTVLANFKIPKQIHFKDGLPRNATGKVLKRVLKEQFEGNK

SEQ ID NO: 863 - protein, 517 aa, Neisseria
MNRTYANFYEMLAAACRKNGNGTAVFDGKEKTAYRALKQEAEAVAAYLQNIGVKFGDTVALAVSNSTEFITAYFAISAIGAVAVPMNTFLKNSEYAYILNDCKARFLFASAGLSKELAGLKAQTPVEKIIWTDKSRPTGETAEGDAFFEDVRRFPEKPDLGRQPRINDLAHIIYTSGTTGHPKGALISYANLFANLNGIERIFKISKRDRFIVFLPMFHSFTLTAMVLLPIYMACSIILVKSVFPFSNVLKQTLLKRATVFLGVPAIYTAMSKAKIPWYFRWFNRIRLFISGGAPLAEQTILDFKAKFPRAKLLEGYGLSEASPVVAVNTPERQKARSVGIPLPGLEAKAVDEELVEVPRGEVGELIVRGGSVMRGYLNMPAATDETIVNGWLKTGDFVTIDEDGFIFIVDRKKDLIISKGQNVYPREIEEEIYKLDAVEAAAVIGVKDRYADEEIVAFVQLKEGMDLGENEIRRHLRTVLANFKIPKQIHFKDGLPRNATGKVLKRVLKEQFDGNK

SEQ ID NO: 864 - protein, 517 aa, Neisseria
MNRTYANFYEMLTAACRKNGNGTAVFDGKEKTAYRALKQEAEAVAAYLQNIGVKFGDTVALAVSNSTEFITAYFAVSAIGAVAVPMNTFLKNSEYAYILNDCKARFLFASAGLSKELAGLKAQTPVEKIIWTGQSRPDGEMAEGDAFFEDVRRFPEKPDLGRQPRINDLAHIIYTSGTTGHPKGALISYANLFANLNGIERIFKISKRDRFIVFLPMFHSFTLTAMVLLPIYMACSIILVKSVFPFSNVLKQALLKRATVFLGVPAIYTAMSKTKIPWYFRWFNRIRLFISGGAPLAEQTILDFKAKFPRAKLLEGYGLSEASPVVAVNTPERQKARSVGIPLPGLEVKAVDEELVEVPRGEVGELIVRGGSVMRGYLNMPAATDETIVNGWLKTGDFVTIDEDGFIFIVDRKKDLIISKGQNVYPREIEEEIYKLDAVEAAAVIGVKDRYADEEIVAFVQLKEGMDLGENEIRRHLRTVLANFKIPKQIHFKDGLPRNATGKVLKRVLKEQFDGNK

SEQ ID NO: 865 - protein, 363 aa, Neisseria
MAEATDVVLVGGGIMSATLGVLLKELEPSWEITLIERLEDVALESSNAWNNAGTGHSALCELNYAPLGADGVINPARALNIAEQFHVSRQFWATLVAEGKLEDNSFINAVPHMSLVMNEDHCRYLQKRYDVFKTQKLFENMEFSTDRNKISDWAPLIMRGRDENQPVAANYSAEGTDVDFGRLTRQMVKYLQGKGVKTEFNRHVEDIKRESDGAWVLKTADTRNPDWQLTLRTRFLFLGAGGGALTLLQKSGIPEGKGYGGLPVSGLFFRNSNPETAEQHNAKVYGQASVGAPPMSVPHLDTRNVDGKRHLMFGPYAGFRSNFLKQGSFMDLPLSIHMDNLYPMLRAGWANMPLTKYLLGELR

SEQ ID NO: 866 - protein, 356 aa, Neisseria
MAEATDVVLVGGGIMSATLGVLLKELEPSWEITLIERLEDVALESSNAWNNAGTGHSALCELNYAPLGANGIIDPARALNIAEQFHVSRQFWATLVAEGKLEDNSFINAVPHMSLVMNEDHCSYLQKRYDAFKTQKLFENMEFSTDRNKISDWAPLMMRGRDENQPVAANYSAEGTDVDFGRLTRQMVKYLQGKGVKTEFNRHVEDIKRESDGAWVLKTADTRNPDGQLTLRTRFLFLGAGGGALTLLQKSGIPEGKGYGGFPVSGLFFRNSNPETAEQHNAKVYGQASVGAPPMSVPHLDTRNVDGKRHLMFGPYAGFRSNFLKQGSLMDLPLSIHMDNLYPMLCAGWANMPLTK

SEQ ID NO: 867 - protein, 488 aa, Neisseria
MAEATDVVLVGGGIMSATLGVLLKELEPSWEITLIERLEDVALESSNAWNNAGTGHSALCELNYAPLGANGIIDPARALNIAEQFHVSRQFWATLVAEGKLEDNSFINAVPHMSLVMNEDHCSYLQKRYDAFKTQKLFENMEFSTDRNKISDWAPLMMRGRDENQPVAANYSAEGTDVDFGRLTRQMVKYLQGKGVKTEFNRHVEDIKRESDGAWVLKTADTRNPDGQLTLRTRFLFLGAGGGALTLLQKSGIPEGKGYGGFPVSGLFFRNSNPETAEQHNAKVYGQASVGAPPMSVPHLDTRNVDGKRHLMFGPYAGFRSNFLKQGSLMDLPLSIHMDNLYPMLRAGWANMPLTKYLLGELRKTKEERFASLLEYYPEANPDDWELITAGQRVQIIKKDSEKGGVLQFGTEIVAHADGSLAALLGASPGASTAVPLMIRLMHQCFPERTPSWEGRLKELVPGYGIKLNENPERADEIIAYTAKVLDI

SEQ ID NO: 868 - protein, 445 aa, Neisseria
  VARIANT (1)...(445): Xaa = Any Amino Acid
MAEATDVVLVGGGIMSATLGVLLKELEPSWEITLIERLEDVALESSNAWNNAGTGHSALCELNYAPLGADGVINPARALNIAEQFHVSRQFWATLVAEGKLEDNSFINAVPHMSLVMNEDHCRYLQKRYDVFKTQKLFENMEFSTDRNKISDWAPLIMRGRDENQPVAANYSAEGTDVDFGRLTRQMVKYLQGKGVKTEFNRHVEDIKRESDGAWVLKTADTRNPDWQLTLRTRFLFLGAGGGALTLLQKSGIPEGKGYGGLPVSGLFFRNSNPETAEQHNAKVYGQASVGAPPMSVPHLDTRNVDGKRHLMFGPYAGFRSNFLKQGSFMDLPLSIHMDNLYPMLRAGWANMPLTKYLLGELRKTKEERFASLLEYYPRQTRRLVLITQXTRHIIXYDSKLRVLQLYEIVPRDARSRILERRGASRXALISADDTAPSAPVLESV

SEQ ID NO: 869 - protein, 488 aa, Neisseria
MAEATDVVLVGGGIMSATLGVLLKELEPSWEITLIERLEDVALESSNAWNNAGTGHSALCELNYAPLGANGIIDPARALNIAEQFHVSRQFWATLVAEGKLEDNSFINAVPHMSLVMNEDHCSYLQKRYDAFKTQKLFENMEFSTDRNKISDWAPLMMRGRDENQPVAANYSAEGTDVDFGRLTRQMVKYLQGKGVKTEFNRHVEDIKRESDGAWVLKTADTRNPDGQLTLRTRFLFLGAGGGALTLLQKSGIPEGKGYGGFPVSGLFFRNSNPETAEQHNAKVYGQASVGAPPMSVPHLDTRNVDGKRHLMFGPYAGFRSNFLKQGSLMDLPLSIHMDNLYPMLCAGWANMPLTKYLLGELRKTKEERFASLLEYYPEANPDDWELITAGQRVQIIKKDSEKGGVLQFGTEIVAHADGSLAALLGASPGASTAVPLMIRLMHQCFPERAPSWEDRLKELVPGYGIKLNENPERADEIIAYTAKVLDI

SEQ ID NO: 870 - protein, 488 aa, Neisseria; identical to SEQ ID NO: 867

SEQ ID NO: 871 - protein, 250 aa, Neisseria
MAAAEIKRPLAVDFQHIASVLHGGIAAFACLIGLQGGMRNQVISQFAAVFGDIAHQFGKQGMAHAVFRPARRRVLSVGFHTFADDGFQVVGMLSGQPDGVLFRQAFNRITDLFFAVVGFAFATLSQSQTGNRRIVDVFDFENRFRRALCRILRLFRRIFGFAAGGKQQAAAQHGKRYFQHSALLMVSKCRLKCRLKRGRRRFGRHWVYFNGRMPTASRTLSNNSRASLRAFCAPACKISSICEGLEVNAL

SEQ ID NO: 872 - protein, 245 aa, Neisseria
  VARIANT (1)...(245): Xaa = Any Amino Acid
MAAAEIKRPFAVDFQHIASVLHGGIAAFACLIGLQGGMRNVIRQFAAVFGDIAHQFGKQGMAHAVFCPTCRTVLIIGFHTFAADGFQVAGMLADQSDNILFRQAFNRITDLFFAVVGFAFAALSQIQTGNRRIVDIYDFENRFRRALYRVLRLYRRIXGFAATAXQQAAAQYGKXXXQHSTXLMVSKCRLKRGRRRFGRHRVHFNGRMPTASGTLSNNSRASLRAFAAPACKISSICEGSAVSSL

SEQ ID NO: 873 - protein, 157 aa, Neisseria
MAAAEIKRPLAVDFQHIASVLHGGIAAFACLIGLQGGMRNQVIRQFAAVFGDIAHQFGKQGMAHAVCRPARRRALSVGFHTFADDGFQVVGMLAGQPDDVLFRQAFKRFGRHWVYFNGRIPTASRTLPNNSRASLRAFCAPACKISSICEGSAVSSL

SEQ ID NO: 874 - protein, 181 aa, Neisseria; identical to SEQ ID NO: 246

SEQ ID NO: 875 - protein, 181 aa, Neisseria
  VARIANT (1)...(181): Xaa = Any Amino Acid
MLXTXFAVLGGCLLXCRCGKSXNTAVQPQNAVQSAPKPVFKVIYIDNTAIAGLDLGQSSEGKTNDGKKQISYPIKGLPEQNVIRLIGKHPGDLEAVSGKCMETDDKDSPAGWAENGVCHTLFAKLVGNIAEDGGKLTDYLVSHAALQPYQAGKSGYAAVQNGRYVLEIDSEGAFYFRRRHY

SEQ ID NO: 876 - protein, 111 aa, Neisseria
SEPLKGLPEQNVVRLTGKHPNDLEAVVGKCMETDGKGAPSGWAANGVCHTLFAKLVGNIAEDGGKLTDYLISHSALQPYQAGKSGYAAVQNGRYVLEIDSEGAFYFRRRHY

SEQ ID NO: 877 - protein, 174 aa, Neisseria
MLKIPFAVLGGCLLLAACGKSENTAEQPQNAAQSAPKPVFKVKYIDNTAIAGLALGQSSEGKTNDGKKQISYPIKGLPEQNAVRLTGKHPNDLEAVVGKCMETDGKDAPSGWAENGVCHTLFAKLVGNIAEDGGKLTDYLISHSALQPYQAGKSGYAAVQNGRYVLEIDSEGAF

SEQ ID NO: 878 - protein, 181 aa, Neisseria; identical to SEQ ID NO: 245

SEQ ID NO: 879 - protein, 109 aa, Neisseria
PLKGLPEQNVVRLTGKHPNDLEAVVGKCMETDGKGAPSGWAANGVCHTLFAKLVGNIAEDGGKLTDYLISHSALQPYQAGKSGYAAVQNGRYVLEIDSEGAFYFRRRHY

SEQ ID NO: 880 - protein, 177 aa, Neisseria
MFSPDKTLFLCLGALLLASCGTTSGKHRQPKPKQTVRQIQAVRISHIGRTQGSQELMLHSLGLIGTPYKWGGSSTATGFDCSGMIQLVYKNALNVKLPRTARDMAAASRKIPDSRLKAGDIVFFNTGGAHRYSHVGLYIGNGEFIHAPGSGKTIKTEKLSTPFYAKNYLGAHTFFTE

SEQ ID NO: 881 - protein, 177 aa, Neisseria
  VARIANT (1)...(177): Xaa = Any Amino Acid
MFPPDKTLFLCLSALLLASCGTTSGKHRQPKPKQTVRQIQAVRISHIDRTQGSQELMLHSLGLIGTPYKWGGSSTATGFDCSGMIQFVYKNALNVKLPRTARDMAAASRKIPDSRXKAGDLVFFNTGGAHRYSHVGLYIGNGEFIHAPSSGKTIKTEKLSTPFYAKNYLGAHTFFTE

SEQ ID NO: 882 - protein, 177 aa, Neisseria
MFPPDKTLFLCLSALLLASCGTTSGKHRQPKPKQTVRQIQAVRISHIDRTQGSQELMLHSLGLIGTPYKWGGSSTATGFDCSGMIQFVYKNALNVKLPRTARDMAAASRKIPDSRLKAGDLVFFNTGGAHRYSHVGLYIGNGEFIHAPSSGKTIKTEKLSTPFYAKNYLGAHTFFTE

SEQ ID NO: 883 - protein, 259 aa, Neisseria
MLRHLGNDFALGALFFDAAVDVPLLGDGQEVVDHPVENQTGREEEEHDGENQRHDFHHFRLHRVGRRRVQIGLGEHRCRHNDGQDVVGVGAAEVGNPAQPRCLAQFYGGEQCPVQADEDGDLQQHRQTAAQRVDFLVFEKLHHRLLLRHTVVAVFFFDGLQFGCGGTHFRHRTVGGVGQWIQYGFDDDGQNDDCPAPVADNVVQLVQEPEERRCEPVYFTVVFCQLQVVGDVCDNGCGLRTGIQVDRHFRFWPPGWDSG

SEQ ID NO: 884 - protein, 340 aa, Neisseria
MLRHLGNDFALGALFFDAAVDVPLLGDGQEVVDYPVQYQTGREEEEHDGENQRHDFHHFRLHRVGRRRVQISLGEHRCRHNDGQDVVGVGAAEVGNPTQPRCLAQFYGGEQCPIQSDEDGDLQQHRQAAAQRVDFLVCVKLHHRLLLRHTVVAVFLFDGLQFGCGGTHFRHRAVRGVGQWIQYGFDDDGNDNRPAPVADDVVQLVQEPEERGGEPVYFAVVFGQLQVVGDVCDDGCGLRAGVEVDGGFGFAPFWMAAKGTLTLVLYSLSLRRLMSMLHSPAAQTLCLPLGWRIQVDMKWCSIMPSQPVGVLRMYSASDLPDLASSSKSEKLTFWKLPSGV

SEQ ID NO: 885 - protein, 340 aa, Neisseria
MLRHLGNDFALGALFFDAAVDVPLLGDGQEVVDHPVQYQTGREEEEHDGENQRHDFHHFRLHRVGRRRVQIGLGEHRCRHNDGQDVVGVGAAEVGNPTQPRCLAQFYGGEQCPIQSDEDGDLQQHRQAAAQRVDFLVCVKLHHGLLLRHTVVAVFLFDGLQFGRGGTHFRHRTVRGVGQWIQYGFDDDGNDNRPAPVADDVVQLVQKPKEGGGEPVYFAVVFGQLQVVGDVCDNGCGLWAGVEVDGGFGFAPFWIAAKGTLTLVLYSLSLRRLMSIRQSPAAQTLCPPLGWRIQVDMKWCSIMPSQPVGVLRMYSASDLPDLASSSKSEKLTFWKLPSGV

SEQ ID NO: 886 - protein, 174 aa, Neisseria
MLRIAAANQLGGRNGAAVGNGVDKFGRGADNQVEFLEGNLIVVGASGRAAVTVAVAQFERAFVVLQREVTFFGEDDVVAAVFVLFAQEQVFHDAGFGVKGFDEINPAVALAQVIELAGFHQRQFLLLLQNFGIFAAAQLCPRYHPKLHDGNQDGKRHGKLHDGAYPLFQRQSAG

SEQ ID NO: 887 - protein, 174 aa, Neisseria
  VARIANT (1)...(174): Xaa = Any Amino Acid
MLRVAAANQLGGRNGTAVGNGVDEFGRGADNQVEFLEGNLIVVGASGRAAVTVAVAQFERAFVVVQREVTFFGEDDVVAAVFVLFAQEQVFHDAGFGIEGFDKINPAVALAQTVELACLHQRQFLLLLQDFSVFAAAXLCPRYHPKLHDGNQNGKRHGKLHHRAYPLFQCQSAG

SEQ ID NO: 888 - protein, 173 aa, Neisseria
MLRVAAANQLGGRNGTAVGNGVDEFGRGADNQVEFLEGNLIVVGASGRAAVTVAVAQFERAFVVVQREVTFFGEDDVVAAVFVLFAQEQVFHDAGFGIEGFDKINPAVALAQTVEPACLHQRQFLLLLQDFSVFAAALCPRYHPKLHDGNQNGKRHGKLHHRAYPLFQCQSAG

SEQ ID NO: 889 - protein, 421 aa, Neisseria
MDNLVWDGIPDIRTLDQTIRKHAHPLNLIVCLPDNQIPDFQTAQDASDSECRLKHRLDQATQCLQFDSINLIEHILPDVRFWLVPPSRTRRLHEHFHHISWQTEAIPQTESKSDKPWFALPQTSERKKPEHVLVIGAGIAGASTAHALASHGISVTVLEARKAAQAASGNRQGLLYAKISPHDTGQTELLLAGYGYTKRLLGHILPDSDTWGGNGIIHLNYSRTEQQRNHELGLQKHHNHLYRSITSAEAEKIAGIPLNTPYAEPLCGLYWQHGVWLNPPAFVRTLLSHPLIELYENTTLTGISHDGEKWIASTPNGTFTATHIIYCTGAHSPCLPETNLAALPLRQIRGQTGLTPSTPFSEQLRCAVSGESYISPSWHGLHCYGASFIPNSSNTGWNEAEEASNRQALAHLNPALAESLF

SEQ ID NO: 890 - protein, 539 aa, Neisseria
  VARIANT (1)...(539): Xaa = Any Amino Acid
MDNLVWDGIPDIRTLDQAIRKHAPPLNLIICLPDNQIPDFQTAQDASDAECRLKHRLDQAMQCLQFDSINLIEHILPDVRFWLVPPSRTHHLHEHFHHISWQTEAIPQTESKPDKPWFALPQTSERQKPEHILVIGAGISGAATAHALASHGISVTVLEARKAAQAASGNRQGLLYAKISPHDTEQTELLLAGYGYTKRLLGHILPESETWGGNGIIHLNYSRTEQQRNHELGLQKHHNHLYRSITSAEAEKIAGIPLSVPYDHPSCGLYWQHGVWLNPPAFVRTLLNHPLIGLHEDTPLTDISHDGEKWIASTPNGTFTATHIIYCTGANSPYLPETNLAALPLRQIRGQTGLTPSTPFSEQLRCAVSGESYISPSWHGLHCYGASFIPNSSHTGWNEAEEASNRQALAHLNPALSESLFAANPNPQKHQGHAAIRCDSPDHLPLVGALGDIAAMRQTYTKLALDKNYRIDTPCPYLPNAYVNTAHGTRGLATAPICAAXXAAQIXGLPHPFXQRLRHALHPNRTIIRAIVRRKDLTP

SEQ ID NO: 891 - protein, 539 aa, Neisseria
MDNLAWNGIPDIRTLDQTIRKHAHPLNLIVCLPDNQIPNFQTAQDASDAECRLKHRLDQATQCLQFDSINLIEHILPDVRFWLVPPSRTRRLHEHFHHISWQTEAIPQTESKPDKPWFALPQTSERQKPEHILVIGAGISGAATAHALASYGISVTVLEARKAAQAASGNRQGLLYAKISPHDTEQTELLLAGYGYTKRLLGHILPESETWGGNGIIHLNYSRTEQQRNHELGLQKHHNHLYRSITQAEAEKIAGIPLNTPYAEPLCGLFWQYGVWLNPPTFVRALLSHPLIGLHEDTPLTDISHDGEKWIASTPNGTFTATHIIYCTGANSPYLPETNLATLPLRQIRGQTGLTPSTPFSEQLRCAVSGESYISPSWHGLHCYGASFIPNSSHTGWNEAEEASNRQALAHLNPALSESLFAANPNPQKHQGHAAIRCDSPDHLPLVGALGDIAAMQQTYAKLALDKNYRIDAPCPYLPNAYANTAHGTRGLATAPICAAAVAAEILGLPHPLSKRLRHALHPNRAIIRAIVRRKDLTP

SEQ ID NO: 892 - protein, 201 aa, Neisseria
MIQKICKLFVLIVIFATSPAFALQSDSRRPIQIEADQGSLDQANQRTTFSGNVIIRQGTLNISASCVNVTRGRQRRRIREGGRFARPLQPNVGRGQRDGARSGKQRYLFLRRKHCRSDRQCQSAARRRRCRRCGHYLQHQNRSLYHQRQHEIGCEIRFQNRQGQRRHPAFKHTKNRITPMPSETETQFRRHLPTEMPRRDY

SEQ ID NO: 893 - protein, 151 aa, Neisseria
MIQKICKLFVLIAFFSASPAFALQSDSRQPIQIEADQGSLDQANQSTTFSGNVVIRQGTLNISAARVNVTRGRQRRRIREGGRFASPLQPDIGRRQRHGARTGKQRCLFICRQHRSLNRCQSTARRRCRRRCGDYIQHQNRSLYHQRQHKI

SEQ ID NO: 894 - protein, 199 aa, Neisseria
  VARIANT (1)...(199): Xaa = Any Amino Acid
MIQKICKLFVLIAFFSASPAFALQSDSRQPIQIEADQGSLDQANQSTTFSGNVVIRQGTLNISAARVNVTRGXQRRRIREGGRFASPLQPDIGRRQRHGARTGKQRCLFICRQHRSLNRCQSTARRRCRRRCGDYIQHQNRSLYHQRQHKIRRKIRFQIRQGQRRYPAFEYAKIRIIPMPSETTWFGRHLPTEILKRYL

SEQ ID NO: 895 - protein, 176 aa, Neisseria
MIQKICKLFVLIVIFATSPAFALQSDSRRPIQIEADQGSLDQANQSTTFSGNVIIRQGTLNISASRVNVTRGGKGGESVRAEGSPVRFSQTLDGGKGTVRGQANNVTYSSAGSTVVLTGNAKVQRGGDVAEGAVITYNTKTEVYTINGSTKSGAKSASKTGRVSVVIQPSSTQKTE

SEQ ID NO: 896 - protein, 176 aa, Neisseria
MIQKICKLFVLIAFFSASPAFALQSDSRQPIQIEADQGSLDQANQSTTFSGNVVIRQGTLNISAARVNVTRGGKGGESVRAEGSPVRFSQTLDGGKGTVRGQANNVAYSSAGSTVVLTGNAKVQRGGDVAEGAVITYNTKTEVYTISGSTKSGAKSASKSGRVSVVIQPSSTQKSE

SEQ ID NO: 897 - protein, 176 aa, Neisseria; identical to SEQ ID NO: 896

SEQ ID NO: 898 - protein, 193 aa, Neisseria
MKVRWRYGIAFPLILAVALGSLSAWLGRISEVEIEEVRLNPDEPQYTMDGLDGRRFDEQGYLKEHLSAKGAKQFPENSDIHFDSPHLVFFQEGRLLYEVGSDEAVYHTENKQVLFKNNVVLTKTADGRRQAGKVETEKLHVDTESQYAQTDTPVSFQYGASHGQAGGMTYNHKTGMLNFSSKVKAAIYDTKDM

SEQ ID NO: 899 - protein, 173 aa, Neisseria
  VARIANT (1)...(173): Xaa = Any Amino Acid
SLSAWLGRISEVEIEEVRLNPDEPQYTMDSLDGRRFDEQGYLKEHLSAKGAKQFPESSDIHFDSPHLVFFQEGRLLYEVGSDEAVYHTENKQVLFKNNVVLTKTADGKRQAGKVEAEKLHVDTESQYAQTDTPVSFQYGASHGQAGGMTYDHXTGMLNFSSKVKATIYDTKDM

SEQ ID NO: 900 - protein, 193 aa, Neisseria
MKVRWRYGIAFPLILAVALGSLSAWLGRISEVEIEEVRLNPDEPQYTMDGLDGRRFDEQGYLKEHLSSKGAKQFPESSDIHFDSPHLVFFQEGRLLYEVGSDEAVYHTENKQVLFKNNVVLTKTADGKRQAGKVEAEKLHVDTESQYAQTDTPVSFQYGASHGQAGGMTYDHKTGMLNFSSKVKATIYDTKDM

SEQ ID NO: 901 - protein, 155 aa, Neisseria
MISISSSVPSDEITAIIPALKRKDITLVCITARPDSTMARHADIHITASVSQEACPLGLAPTTSTTAVMALGDALAVVLLRARAFTPDDFALIHPAGSLGKRLLLRVADIMHKGGGLPAVRLGTPLKGAIVSMSEKGLGMWAGTDGQRLSERPFY

SEQ ID NO: 902 - protein, 326 aa, Neisseria
  VARIANT (1)...(326): Xaa = Any Amino Acid
MAMAENGKYLDWAREVLHAEAEGLREIAAELXKNFVLAADALLHCKGRVVITGMVKSGHIGRKMAATMASTGTPAFFVHPAEAAHGDLGMIVDXDVVVAISNSGESDEIAAIIPALKRKDITLVCITARPDSTMARHADIHITASVSKEACPLGLAPTTSTTAVMALGDALAVVLLRARAFTPDDFALSHPAGSLGKRLLLRVADIMHKGGGLPAVRLGTPLKEAIVSMSEKGLGMLAVTDGQGRLKGVFTDGDLRRLFQECDNFTGLSIDEVMHTHPKTISAERLATEALKVMQANHVNGLLVTDADGVLIGALNMHDLLAARIV

SEQ ID NO: 903 - protein, 326 aa, Neisseria
MAMAGNEKYLDWAREVLHTEAEGLREIAADLDENFALAADALLHCKGRVVITGMGKSGHIGRKMAATMASTGTPAFFVHPAEAAHGDLGMIVDNDVVVAISNSGESDEIAAIIPALKRKDITLVCITARPDSTMARHADIHITASVSKEACPLGLAPTTSTTAVMALGDALAVVLLRARAFTPDDFALSHPAGSLGKRLLLRVADIMHKGGGLPAVRLGTPLKEAIVSMSEKGLGMLAVTDGQGRLKGVFTDGDLRRLFQECDNFTGLSIDEVMHTHPKTISAERLATEALKVMQANHVNGLLVTDADGVLIGALNMHDLLAARIV

SEQ ID NO: 904 - protein, 226 aa, Neisseria
MADDGLLRQLSEKPSQSALFLPFDPFVFEVLDCLLVIGPGLKQCFKQIPATRHPFADRRRLPPYPGNIRQGFEEGGKTSEHGGLIHVGIPRADILPHRVAAFGQHPAQYHTVCRLLPGKQLIRAAAHFSVQSPMDVQIGNHIVQKRQIVPGQSETAQHGRGFQKREHFADFKTAFQQVGHALQRIKKRLPAADFHVRNGIRQCLRAGLRLSEHGFHKRRIGFDIRG

SEQ ID NO: 905 - protein, 226 aa, Neisseria
  VARIANT (1)...(226): Xaa = Any Amino Acid
MADDGVRRQLSGKLRQFGFRLPFDPFVFKVLDXLLVIGFSLEQCFKQIPATRHPFADRCGLPPYPYNIRQGFEEGGKTSEHGGLIHVGIPRADILPHRIAAFGQHPAQYHAFYRLLPGEQLIRAAAHFSVQTPVDVQIGNHVVQKRXIVLSQSETAQHGRGFXKHKHFIDFKSAFQQVEQAXQSMKQRLAAADFHVXHGIRQCLRTGLRLSEHGFDKRRIGFDIRG

SEQ ID NO: 906 - protein, 224 aa, Neisseria
VADDGVQRQLSGKLRQFGFRLPFDPFVFEALDCLLVIAFDLEQCFKQIPATRHPFVNRRRLPPYPYNIRQGFEEGGKTSEQGGLVHVGIPRADPLPHRIAAFGQHPAQYHAFYRLLPGEQLIRAAAHFSVQTPADVQIGNHVVQKRQIVLSQSEMAQHGRGFKHKHFIDFKSAFQQVEQAQSMKQRLSAADFHIRNGIRQCLRAGLRLSEHGFDKRRIGFDIRG

SEQ ID NO: 907 - protein, 218 aa, Neisseria
MVAVDPYTAKVVNTMPRNQGWYHTMDEIHGDMMLGAAGDYLLETAASLTIIMVVSGLYLWWAKQRGIKAMLLPPKSRARSWWRNLHGAFGTWVSLILLLFCLSGIAWAGIWGGKFVQAWNQFPAGKWGVEPNPVSIVPTHGEVLNDGKVKEVPWILELMPMPVSGTTVGENGINPTEPNNIGNRRPFRAGNRFQRALSVEFAQRRGRGMDFVAGFYEL

SEQ ID NO: 908 - protein, 218 aa, Neisseria
  VARIANT (1)...(218): Xaa = Any Amino Acid
MVAVDPYTAKVVSTMPRNQGWYYTMDEIHSDMMLGAAGDYLLETAASLTIIMVVSGLYLWWVKRRGIKAMLLPSKGXARSWWRNLHGTFGTWVSLILLLFCLSGIAWAGIWGGKFVQAWSQFPAGKWGVEPNPVSVVPTHGEVLNDGKVKEVPWVLELTPMPVSGTTVGKDGINPDEPMTLETVDRFARXNRFQRALSVEFAQRRGRRMDFVAGFYEL

SEQ ID NO: 909 - protein, 218 aa, Neisseria
  VARIANT (1)...(218): Xaa = Any Amino Acid
MVAVDPYTAKVVSTMPRNQGWYYAMDEIHSDMMLGSTGDYLLETAASLTIIMIISGLYLWWVKRRGIKAMLLPPKGRARSWWRNLHGAFGTWVSLILLLFCLSGIAWAGIWGGKFVQAWSQFPAGKWGVEPNPVSVVPTHGEVLNDGKVKEVPWVLELTPMPVSGTTVGKDGINPDEPMTLETVDRFARXNRFQRALSAEFAQRRGRRMDFVAGFYEL

SEQ ID NO: 910 - protein, 213 aa, Neisseria
MTARLRKCRGFWSLCLCLSQGRLWVKTALTPPSPITLETVDRFAREIGFKGRYQLNLPKGEDGVWTLSQDSMSYDMISPFADRTVHIDQYSGEILADIRFDDYNPFGKFMAASIALHMGTLGWWSVLANVVFCLAVIFIGISGCVMWWKRRPSGVAGIVPPAQKIKLPVWWAMALPLLLIALLFPTALLAIAVIWLLDTLLLSRIPVLRKWFK

SEQ ID NO: 911 - protein, 213 aa, Neisseria
  VARIANT (1)...(213): Xaa = Any Amino Acid
MTARLRKCRGFWSLRLCLFQGRXWAKTALTLTSRXHWKPSTALRGEIGFKGRYQLNLPKGEDGVWTLSQDSMSYDMISPFADRTVHIDQYSGKILADIRFDDYNPFGKFMAASIALHMGTLGWWSVLANVLFCLAVIFIGISGCVMWWKRRPTGAVGIVPPAQKVKLPVWWMMALPLLAIALLFPTSLLAIAVIWLLDTLLLSRIPVLRRWFK

SEQ ID NO: 912 - protein, 212 aa, Neisseria
  VARIANT (1)...(212): Xaa = Any Amino Acid
MTARLRKCRGFWSLRLCLFQGRLWAKTVLTLTSRHWKPSTVLRXEIGFKGRYQLNLPKGEDGVWTLSQDSMSYDMISPFADRTVHIDQYSGKILADIRFDDYNPFGKFMAASIALHMGTLGWWSVLANVLFCLAVIFIGISGCVMWWKRRPSGAVGMVPPAQKIKLPVWWAMAVPLLLIALLFPTALLAIAVIWLLDTLLLSRIPVLRRWFK

SEQ ID NO: 913 - protein, 185 aa, Neisseria
  VARIANT (1)...(185): Xaa = Any Amino Acid
MHDHGAMDRRLPAFGSLMRRAVNXIDADGFEPCLTGGIDDFFGFFVALDAVDCRLHFGVEILNADAHAVEAESAEHEDGVAADFARVDFDGIFAGRYQFEMFADHAEDTFDLFVAQKGRRAAAEVQLGKLVPSVQMWSEQFHFFFKIFDVGIGAAFVFGDDFVAAAVVADGVAKRNVNVKGKRFV

SEQ ID NO: 914 - protein, 176 aa, Neisseria
  VARIANT (1)...(176): Xaa = Any Amino Acid
MXVLMXRSLVRQAVNQIDADGFEPRFARRIDDFFGFFVTLDAVDRRLHFGVEILNADAHAVEAESAEHEDGVAADFARVDFDGVFAGGDXLEMFAYHAEDTFDLFVAQKGACPAEVQLGKLVPSVQMWSEQFHFFFKIFDVGIGAAFVFGDDFVAAAVVADGVAERNVNVKGKRFV

SEQ ID NO: 915 - protein, 176 aa, Neisseria
MVVLMLRSLVRQAVNQIDADGFEPRFARRIDDFFGFFVTLDAVDRRLHFGVEILNADAHAVEAESAEHEDGVAADFARVDFDGVFAGGDLEMFAYHAEDTFDLVVAQKGRRAAAEVQLGKLVPSVQMWSEQFHFFFKKFDVGIGAAFVFGDDFVAAAVVADGVAERNVNVKGKRFV

SEQ ID NO: 916 - protein, 119 aa, Neisseria
MEFRHQVVVVGVEPFGHFDGELVFVAARQLEELFQRQVLAIEAETGGNRARGYLQVEDVMVESEITYSNVISVRSSLVFPVFLAQVFGNVEQLLFTDLFAPVFFLGEFQFTEGADTREA

SEQ ID NO: 917 - protein, 119 aa, Neisseria
  VARIANT (1)...(119): Xaa = Any Amino Acid
VEFRHQVVVVGVEPFGHFDSELVFVTARQLEELFQRQVLAVEAEAGGNRAGGDLQVEDVVVESEIXYGNEIGVGSDLVFPVFLAQVFSNSQQFLLADFFAPVFFLCEFQFAEGADTREA

SEQ ID NO: 918 - protein, 118 aa, Neisseria
VEFRHQVVVVGVEPFGHFDSELVFVTARQLEELFQRVLAVEAEAGGNRAGGDLQVEDVVVESEIAYGNVIGVGSGLVFPVFLAQVFSNSQQFLLADFFAPVFFLCEFQFAEGTDTREA

SEQ ID NO: 919 - protein, 222 aa, Neisseria
  VARIANT (1)...(222): Xaa = Any Amino Acid
MDSFFKPAVWAVLWLMFAVRPALADELTNLLSSREQILRQFAEDEQPVLPVNRAPARRAGNADELIGGAMGLNEQPVVRVNRAXARRAGNADKLIGSAMRLLGIAYRYGGTSVSTGFDCSGFMQHIFKRAMGINLPRTSAEQARMGAPVARSELQPGDMVFFRTLGGSRISHVGLYIGNNRFIHAPRTGKNIEITSLSHKYWSGKYAFARRVKKNDPSRFLN

SEQ ID NO: 920 - protein, 248 aa, Neisseria
  VARIANT (1)...(248): Xaa = Any Amino Acid
FSNPAVWAVLWLXFAVRPALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 921 - protein, 280 aa, Neisseria
  VARIANT (1)...(280): Xaa = Any Amino Acid
MDSFFKPAVWAVLWLMFAVRPALADELTNLLSSREQILRQFAEDEQPVLPINRXPARRAGNADELIGSAMGLNEQPVLPVNRXPARRAGNADXLIGNAMGLNEQPVLPVNRVPARRAGNADELIGNAMGLNEQPVLPVNRAPARRAGNADELIGNAMGLLGIAYRYGGTSISTGFDCSGFMQHIFKRAMGINLPRTSAEQARMGTPVARSELQPGDMVXFRTLGGSRISHVGLYIGNNRFIHAPRTGKNIEITSLSHKYWSGKYAFARRVKKNDPSRFLN

SEQ ID NO: 922 - protein, 222 aa, Neisseria; identical to SEQ ID NO: 919
  VARIANT (1)...(222): Xaa = Any Amino Acid

SEQ ID NO: 923 - protein, 251 aa, Neisseria
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 924 - protein, 280 aa, Neisseria; identical to SEQ ID NO: 921
  VARIANT (1)...(280): Xaa = Any Amino Acid

SEQ ID NO: 925 - protein, 198 aa, Neisseria
MSEILRQPSVLLFLTLAVYALAIIVRTRTGNIFCNPVLVSTIVLIAYLKILGIDYAVYHNAAQFIDFRLKPAVVVLAVPLYQNRRKIFNQWLPVIVSQLAGSVTGIVTGMYFAAWLGPDTQFSFPPRLQYLLFTPSGIPIHTLYARVLPPFLLPPPLLPRLGPHTLRRFTILPKKLRPFKPLLPVVVLSPPGLAPPLL

SEQ ID NO: 926 - protein, 230 aa, Neisseria
MNEILRQPSVLLFLTLAVYALAIIVRTRTGNIFCNPVLVSTIVLIAYLKILGIDYAVYHNAAQFIDFWLKPAVVVLAVPLYQNRRKIFNQWLPVIVSQLAGSVTGIVTGMYFAKWLGAEREVVLSLASKSVTNPIAIEITRSIGGIPAITAATVIIAGLVGQIAGYKMLKNTVVMPSSVGMSLGTASHAMGIAASLERSRRMAAYAGLGLTFNGVLTALIAPLLIPVLGF

SEQ ID NO: 927 - protein, 230 aa, Neisseria
MNEILRQPSILLFLTLAVYALAIIVRTRTGNIFCNPVLVSTIVLIAYLKILGIDYAVYHNAAQFIDFWLKPAVVVLAVPLYQNRRKIFNQWLPVIVSQLAGSVTGIVTGMYFAKWLGAEREVVLSLASKSVTNPIAIEITRSIGGIPAITAATVIIAGLVGQIAGYKMLKNTVVMPSSVGMSLGTASHAMGIAASLERSRRMAAYAGLGLTFNGVLTALIAPLLIPVLGF

SEQ ID NO: 928 - protein, 114 aa, Neisseria
MNIIRALLIILGCLAAGETAVFLAGIKLPGSIVGMGVLFALLQAGWLKTSWLQQLTDALMANLTLFLVPPCVAVISYLDLIADDWFSILVSASASTLCVLLVTGKVHRWIRSII

SEQ ID NO: 929 - protein, 67 aa, Neisseria
  VARIANT (1)...(67): Xaa = Any Amino Acid
TSXLQQLTDALMSNLTLFLVPPCVAVISYLDLIADDWFSILVSASASTLCVLLVTGKVHRWIRGIIR

SEQ ID NO: 930 - protein, 114 aa, Neisseria
MNIIRALLIILGCLATGETAVFLAGIKLPGSIVGMGVLFALLQAGWVKTSWLQQLTDALMANLTLFLVPPCVAVISYLDLIADDWFSILVSASASTLCVLLVTGKVHRWIRSII

SEQ ID NO: 931 - protein, 107 aa, Neisseria
MKKLLIAAMMAAALAACSQEAKQEVKEAVQAVESDVKDTAASAAESAASAVEEAKDQVKDAAADAKASAEEAVTEAKEAVTEAAKDTLNKAADATQEAADKMKDAAK

SEQ ID NO: 932 - protein, 107 aa, Neisseria; identical to SEQ ID NO: 931

SEQ ID NO: 933 - protein, 196 aa, Neisseria
MAAVSGGGAVFLIMLPHIARVQRQPPAFAQASGEIGIEAAGEIVSAAAQEVLPDKRHGAERARYRTVLMAERQAQVLFAEIFVIPIMHAAADAAVEEMMPARIDFARHAQAVAQTVCLLRQAVGGFRPASARKFNRFFGRSVVYSGLTKIRTRRRAAGSTDGTEPVRPVLGRLREPFPLSRGGATRTGFCSSAILC

SEQ ID NO: 934 - protein, 160 aa, Neisseria
  VARIANT (1)...(160): Xaa = Any Amino Acid
AQALGEIGIEAADEIVSAAAXEVLLDKRHDAERARYRTVFIAERQAQALFAEIFVIPIMHAAAADAAVEEMMPARIDFARHAXALAQTVCLLRQAVGGFRPASARKFNRFFGRSVVYSGLTKIRTRQRSADSTNSTEPIHLVLQHLRESRSLFCSSAILC

SEQ ID NO: 935 - protein, 191 aa, Neisseria
  VARIANT (1)...(191): Xaa = Any Amino Acid
MAVVSGGGAVFLITLPHIAHVQRQPPXFAQASGEIGIEAADEIVSAAAEVLLDKRHDAEARYTVFIAERQAQALFAEIFVILIVHAAAADVSVEEMMPARIDFARHAQAVAQTVCLLRQAVGGFRPASACKFNRFFGRSVVYSGLTKIRTRRRSADSTDSTEPIHLVLQHLRESSLAKARQRRTGFCSSTI

SEQ ID NO: 936 - protein, 390 aa, Neisseria
MFHSIEKYRTPAQVLLGLIALTFVGFGVSTVSHPGADYIVQVGDEKISEHSINNAMQNEQADGGSPWRDAVFQSLLQRAYLKQGAKLMGISVSSEQIKQMIVDDPNFHDANGKFSHALLSQYLSQRHMSEDQFVEEIRDQFALQNLVSLVQNGVLVGDAQAEQLIRLTQVNRTIRSHTFNPDEFIAQVKASEADLQKFYNANKKDYLLPQAVKLEYVALNLKDFADKQTVSETEVKNAFEERVARLPAHEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKNLLFEEAKDAVRQAYIRTEAAKLLKTM

SEQ ID NO: 937 - protein, 386 aa, Neisseria
MFHSIEKYRTPAQVLLGLIALTFVGFGVSTVSHPGADYIVQVGDEKISDHSINNAIQNEQADGGGPSPDAVFQSLLQRAYLKQGAKLMGISVSSEQIKQIIVDDPNFHDANGKFDHALLNRYLSQRHMSEDQFVEEIRDQFALQNLVNLVQNGVLVGDAQAEQLIRLTQVNRTIRSHTFNPDEFIAQVKVSEADLQKFYNANKKDYLLPQAVKLEYVALNLKDFADKQTVSETEVKNAFEERVARLPANEAKPSFEQEKAAVENELKMKKAVADFNKAKEKLGDDAVNHPSSLAEAAKNSGLKVETQETWLSRQDAQMSGMPENLINAVFSDDVLKKKHNSEVLTINSETAWVVRAKEVREEKTLPFAEAKDAVRQAYIRTEAAKL

SEQ ID NO: 938 - protein, 386 aa, Neisseria
MFHSIEKYRTPAQVLLGLIALTFVGFGVSTVSHPGADYIVQVGDEKISDHSINNAIQNEQADGGGPSRDAVFQSLLQRAYLKQGAKLMGISVSSEQIKQIIVDDPNFHDANGKFDHALLNRYLSQRHMSEDQFVEEIRDQFALQNLVNLVQNGVLVGDAQAEQLIRLTQVNRTIRSHTFNPDEFIAQVKVSEADLQKFYNANKKDYLLPKAVKLEYVALNLKDFADKQTVSETEVKNAFEERVARLPANEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKTLPFAEAKDAVRQAYIRTEAAKL

SEQ ID NO: 939 - protein, 512 aa, Neisseria
MFHSIEKYRTPAQVLLGLIALTFVGFGVSTVSHPGADYIVQVGDEKISEHSINNAMQNEQADGGSPWRDAVFQSLLQRAYLKQGAKLMGISVSSEQIKQMIVDDPNFHDANGKFSHALLSQYLSQRHMSEDQFVEEIRDQFALQNLVSLVQNGVLVGDAQAEQLIRLTQVNRTIRSHTFNPDEFIAQVKASEADLQKFYNANKKDYLLPQAVKLEYVALNLKDFADKQTVSETEVKNAFEERVARLPAHEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKNLLFEEAKDAVRQAYIRTEAAKLAENKAKEVLTQLNGGKAVDVKWSEVSVLGAQQARQSMPPEAYAELLKAKPANGKPAYVRLTGLPAPVIVEAQAVTPPEDIAAQLPPAKQALAQQQSANTFDLLIRYFNGKIKQTKGAQSVDNGDGQ

SEQ ID NO: 940 - protein, 512 aa, Neisseria
MFHSIEKYRTPAQVLLGLIALTFVGFGVSTVSHPGADYIVQVGDEKISDHSINNAIQNEQADGGGPSRDAVFQSLLQRAYLKQGAKLMGISVSSEQIKQIIVDDPNFHDANGKFDHALLNRYLSQRHMSEDQFVEEIRDQFALQNLVNLVQNGVLVGDAQAEQLIRLTQVNRTIRSHTFNPDEFIAQVKVSEADLQKFYNANKKDYLLPQAVKLEYVALNLKDFADKQTVSETEVKNAFEERVARLPANEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKTLPFAEAKDAVRQAYIRTEAAKLAENKAKDVLTQLNGGKAVDVKWSEVSVLGAQQARQSMPPEAYAELLKAKPANGKPAYVRLIGLPAPVIVEVQAVTPPDDIAAQLPLAKQALAQQQSANTFDLLIRYFNGKIKQTKGAQSVDNGDGQ

SEQ ID NO: 941 - protein, 512 aa, Neisseria
MFHSIEKYRTPAQVLLGLIALTFVGFGVSTVSHPGADYIVQVGDEKISDHSINNAIQNEQADGGGPSRDAVFQSLLQRAYLKQGAKLMGISVSSEQIKQIIVDDPNFHDANGKFDHALLNRYLSQRHMSEDQFVEEIRDQFALQNLVNLVQNGVLVGDAQAEQLIRLTQVNRTIRSHTFNPDEFIAQVKVSEADLQKFYNANKKDYLLPKAVKLEYVALNLKDFADKQTVSETEVKNAFEERVARLPANEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKTLPFAEAKDAVRQAYIRTEAAKLAENKAKDVLTQLNGGKAVDVKWSEVSVLGAQQARQSMPPEAYAELLKAKPANGKPAYVRLIGLPAPVIVEVQAVTPPDDIAAQLPLAKQALAQQQSANTFDLLIRYFNGKIKQTKGAQSVDNGDGQ

SEQ ID NO: 942 - protein, 301 aa, Neisseria
MSKRKSINRPYQKPAELPPLQNNPPFYRKNRRLNFFIAADGGCASPQKCRARGFQTAFAVQGRAVSLPNAQPFAHGIHPILIAPAAPACPAVRPRRLRIFSFPQSFAFPFRLNLSVGIVGKIRLILLFFSITFIMPRRPVLHLHQVQIGFAGGYLRHFALIAVGFKHTYTDFPTLRRRAQVVARTCTVSLFHLRCVDIRHPNFMFRAVAVDDVKGIAVIDFGHRACVAVAGFRRCPSANGRVETHVPCSAEYVEYGNRRPHRLTVISRITQRAQKRQGDGKPFHDFFNLHIFQMPMPSEHL

SEQ ID NO: 943 - protein, 74 aa, Neisseria
MSKRKSINRPYQKPAELPPLQNNPPFYRKNRRLNFFIAADGGCASPQKCRARGFQTAFAVQSRAVSLPNAQPFG

SEQ ID NO: 944 - protein, 301 aa, Neisseria
  VARIANT (1)...(301): Xaa = Any Amino Acid
MSKRKSINRPYQKPAELPPLQNNPPFYRKNRRLNFFIXADGGCASPQKCRARGFQTAFAVQSRAVSLPNAQPFAHGIHPILIAPAAPACPAVRPRRLRIFSFPQSFAFPFRLNLSVGIIGKIRLILLFFSITFIMPRRPVLHLHQVQIGFADRNLRHFALVAVGVEHADADFPAFRRRAQVVARTRAVSLFHLRRVDIRHPDFVFRAVAVDNVKGVAVIDFGHRACVAVAGFRRCSAAGGRVGTRVPCRAEYVEYGNRRPHRLAAVPRITQRTQKRQGDGKPFHDFFNLHIFQMPMPSEHI

SEQ ID NO: 945 - protein, 233 aa, Neisseria
MSKRKSINRPYQKPAELPPLQNNPPFYRKNRRLNFFIAADGGCASPQKCRARGFQTAFAVQGRAVSLPNAQPFAHGIHPILIAPAAPACPAVRPRRLRIFSFPQSFAFPFRLNLSVGIVGKIRLILLFFSITFIMPRRPVLHLHQVQIGFAGGYLRHFALIAVGFKHTYNEFRTLRRRAQVVARTCTVSVFHLRCVDIRHPNFMFRAVAVDDVKGIAVIDFGHRACVAVAGFR

SEQ ID NO: 946 - protein, 309 aa, Neisseria
MSKRKSINRPYQKPAELPPLQNNPPFYRKNRRLNFFIAADGGCASPQKCRARGFQTAFAVQSRAVSLPNAQPFAHGIHPILIAPAAPACSAVRPRRLRIFSFPQSFAFPFRLNLSVGIIGKIRLILLFFSITFIMPRRPVLHLHQVQIGFADRNLRHFALVAVGIEHAHADFPAFRRRAQVVARTRAVSLFHLRRVDIRHPDFVFRAVAVDNVKGVAVIDFGHRACVAVAGFRRCSAAGGRVGTRVPCRAEYVEYGNRRPHRLAAVPRITQRTQKRQGDGKPFHDFFNLHIFQMPMPSEHIGIGFQTAS

SEQ ID NO: 947 - protein, 309 aa, Neisseria
MSKRKSINRPYQKPAELPPLQNNPPFYRKNRRLNFFIAADGGCASPQKCRARGFQTAFAVQSRAVSLPNAQPFAHGIHPILIAPAAPACPAVRPRRLRIFSFPQSFAFPFRLNLSVGIIGKIRLILLFFSITFIMPRRPVLHLHQVQIGFADRNLRHFALVAVGVEHADADFPAFRRRAQVVARTRAVSLFHLRRVDIRHPDFVFRAVAVDNVKGVAVIDFGHRACVAVAGFRRCSAAGGRVGTRVPCRAEYVEYGNRRPHRLAAVPRITQRTQKRQGDGKPFHDFFNLHIFQMPMPSEHIGIGFQTAS

SEQ ID NO: 948 - protein, 290 aa, Neisseria
MMGNSLIESGTFVAILFGQILGTAVAGAPPYIVGILVLLVAVGGTAGSLFMPSVPAKAADTQIEWNIVRGTKSLLRETVRHNPVFTAIIGISWFWFVGAVYTTQLPTFTQIHLGGNDNVFNLMLALFSIGIAAGSVLCAKFGRERLMLAWVTVGALGSTVCGLVLVWLTHGHRFEGLNGIFWFLSQGWAYPVMAVMTLIGFFGGFFSVPLYTWLQTASSETFRARAVAANNIVNGIFMVSAAVLSAVLLFLFDSISLLYLIVALGNIPLAVFLIKRERRFLGAAAIRKKP

SEQ ID NO: 949 - protein, 288 aa, Neisseria
  VARIANT (1)...(288): Xaa = Any Amino Acid
MMGNSLIESGTFVAILFGQILGTAVAGVPPYIVGILVLLVAVGGTVGSLFMPSVPAKAADTQIEWNIVRGTKSLLRETVRHKPVFTAIIGISWFWFVGAVYTTQLPTFTQIHLGGNDNVFNLMLALFSIGIAAGSVLCAKFSXERLMLAWVTVGALGLTVCGLVLVWLTHGHRFEGLNGIFXFLSQGWAYPVMAVMTLIGFFGGFFSVPLYTVQTAIARFPRPAVAANNIVNGIFMVSAAVLSAVLLFLFDSISLLYLIVALGNIPLSVFLIKRERRFLGAAAIRKKP

SEQ ID NO: 950 - protein, 436 aa, Neisseria
MYAKKGGLGLVKSRRFAPLFATQFLGAFNDNVFKTALFVMIGFYGLGQNGFLPAGQMLNLGALLFILPYFLFSSLSGQLGNKFDKAVLARWAKVLEMIIMAVAAYGFYIRSAPLLLACLFCMGAQSTLFGPLKYAILPDYLDDKELMMGNSLIESGTFVAILFGQILGTAVAGVPPYIVGILVLLVAVGGTVGSLFMPSVPAKAADTQIEWNIVRGTKSLLRETVRHKPVFTAIIGISWFWFVGAVYTTQLPTFTQIHLGGNDNVFNLMLALFSIGIAAGSVLCAKFSRERLRLAWVTVGALGLTVCGLVLVWLTHGHRFEGLNGIFWFLSQGWAYPVMAVMTLIGFFGGFFSVPLYTWLQTASSETFRARAVAANNIVNGIFMVSAAVLSAVLLFLFDSISLLYLIVALGNIPLSVFLIKRERRFLGAAAIRKKP

SEQ ID NO: 951 - protein, 229 aa, Neisseria
MKRKNIALIPAAGIGVRFGADKPKQYVEIGSKTVLEHVLGIFERHEAVDLTVVVVSPEDTFADKVQTAFPQVRVWKNGGQTRAETVRNGVAKLLETGLAAETDNILVHDAARCCLPSEALARLIEQAGNAAEGGILAVPVADTLKRAESGQISATVDRSGLWQAQTPQLFQAGLLHRALAAENLGGITDEASAVEKLGVRPLLIQGDARNLKLTQPQDAYIVRLLLNAV

SEQ ID NO: 952 - protein, 152 aa, Neisseria
MKRKNIALIPAAGIGARFGADKPKQYVEIGSKTVLEHTIGIFERHEAVDLTVVVVSPEDTFADKVQTAFPQVRVWKNGGQTRAETVRNGVAKLLETGLAAETDNILVHDAARCCLPSEALTRLIEQAGNAAEGGILAIPIADTLKCADGGNI

SEQ ID NO: 953 - protein, 229 aa, Neisseria
MKRKNIALIPAAGIGARFGADKPKQYVEIGSKTVLEHTIGIFERHEAVDLTVVVVSPEDTFADKVQTAFPQVRVWKNGGQTRAETVRNGVAKLLETGLAAETDNILVHDAARCCLPSEALTRLIEQAGNAAEGGILAIPVADTLKCADGGNISATVERTSLWQAQTPQLFRAGLLHRALAAENLDGITDEASAVEKLGIRPLLVQGDARNLKLTQPQDAYIVRLLLDAV

SEQ ID NO: 954 - protein, 223 aa, Neisseria
MKTVSAAIAFAAAAVSLTGCATESSRSLEVAKVASCNTQYHGVRTPISVGTFDNRSSFQKGIFSDSEDRLGSQAKTILVTHLQQTNRFNVLNRTNLSALKQESGISGKAQNLKGADYVVTGDVTEFGRRDVGDHQLFGILGRGKSQIAYAKVALNIVNVNTSEIVYSTQGAGEYALSNREIIGFGGTSGYDATLNGKVLDLAIREAVDNLVQAVDNGAWQSNR

SEQ ID NO: 955 - protein, 54 aa, Neisseria
GAGEYALSNREIIGFGGTSGYDATLNGKVLDLAIREAVNSLVQAVDNGAWQPNR

SEQ ID NO: 956 - protein, 132 aa, Neisseria
  VARIANT (1)...(132): Xaa = Any Amino Acid
NRTYLNALKQESGISGKAHNLKGANYVXTGDVTEFGRXDVGDHQLFGILGRGKSQIAYAKVALNIVNVNTSEIVYSAQGAGEYALSNREIIGFGGTSGYDATLNGKVLDLAIREAVNSLVQAVDNGAWQPNR

SEQ ID NO: 957 - protein, 215 aa, Neisseria
MKPLILGLAAVLALSACQVRKAPDLDYTSFKESKPASILVVPPLNESPDVNGTWGMLASTAAPISEAGYYVFPAAVVEETFKENGLTNAADIHAVRPEKLHQIFGNDAVLYITVTEYGTSYQILDSVTTVSAKARLVDSRNGKELWSGSASIREGSNNSNSGLLGALVGAVVNQIANSLTDRGYQVSKTAAYNLLSPYSRNGILKGPRFVEEQPK

SEQ ID NO: 958 - protein, 215 aa, Neisseria
MKPLILGLAAVLALSACQVQKAPDFDYTSFKESKPASILVVPPLNESPDVNGTWGVLASTAAPLSEAGYYVFPAAVVEETFKQNGLTNAADIHAVRPEKLHQIFGNDAVLYITVTEYGTSYQILDSVTTVSAKARLVDSRNGKELWSGSASIREGSNNSNSGLLGALVSAVVNQIANSLTDRGYQVSKTAAYNLLSPYSHNGILKGPRFVEEQPK

SEQ ID NO: 959 - protein, 215 aa, Neisseria; identical to SEQ ID NO: 958

SEQ ID NO: 960 - protein, 345 aa, Neisseria
MARFAFSADILRTAFADGFITCNRAHIAGVMPAAFAFFAVAGFGGNGKFITDFHFCFRHQQGKAQFFAQSIQIAGHFFRRGNFGFRLQGRTDSFVGAQRLDSGGYCFARFADCRPFFHQFGFGFFVDGRELVPSMEEDAVFFAAADDVPRFFAGEAQNRCNQENQAARDVVQGGLRAAAGAAVGFGGVEAVFQDVEVERAQVFRAERNNVFHGEVEGIARIVTACQTLLQPPRQYQGVAVDFHHIRLLHGIFNRIKVAQIGKQEAQGIADAAVAFGNAFEDFFGNRQFAAVIGGCRPQAQDVRAEFVIDFLRRDDVADGFRHFAAVLVNHETVGQQLFIRCASHG

SEQ ID NO: 961 - protein, 258 aa, Neisseria
  VARIANT (1)...(258): Xaa = Any Amino Acid
LHGRTDGFVGAQRLDGGGYRFAGFADCRPFFHQFGFGFFVDGRELVPSMEEDAVXFAAAXDVPRFFAGEAQNRCNQENQTACDVIQGSLCAAACMAVCFGGVEAVFQDVEVERTQVFRAERNXVFYGKVEXITRIVIACQTLLQLTCQYHGVAVDFHHIRLLHGIFNRIKVAQVGKQKAQGIADTAVAFGYAFEDFFGNRQFAAVIGRCRPQAQDVCAEFVINLLRCNDVADGFRHFFAFAVDNETMGQQLFIRRATH

SEQ ID NO: 962 - protein, 344 aa, Neisseria
MARFAFSADILCTAFADGFMACNRAHIAGVVPAAFAFFTITGFSGNGKFAAYFHFCFRHQQSKAQFFAQSIQIAGHFFRRGNFGFGLQGRTDGFVGAQRLDGGGYRFAGFADCRPFFHQFGFGFFVDGRELVPSMEKHAVFCAAADDVPRFFAGEAQNRCNQENQAARDVVQGGLRAAAGAAVGFGGIEAVFQDIEVERAQVFRAERNHFFHGKVEGITRIKITGNAFLQPPCQHQGIAVDFHHIRLLHGIFNRIEVAQVGKQKAQGIADTAVAFGYALEDFFGNRQFAAVIGGCRPQAQDVRAELVIHFLRRDDVADGFRHFAPVLIHHETMGQQLFVRRATH

SEQ ID NO: 963 - protein, 382 aa, Neisseria
MRDKVGGNIALPAPRIFDSNIGKLRKNFKHILADKLGHTRRIVDKFVILTAEKQPAVRAEAVIIQNMAVVAYCHIVADKPFCARAQGFGGNNKGADGNRLAFQRPEYRVQTDISIDGIDHIFTLDAAFGRVNQPTVLIRFDARHRGLLENLRAGFGSGAGNTQRVIERMKMPGQGIELCALVHIAVKLLFQLGFIPKLIMTRTVMPLGVFMPLLQLFPMLRTDGNRGITALPIAIDGMFADAFVHQFDRLQRLLPKPLRLLQADLFFNFPHTAGVVADNLPATPAGRAEADTCGFQNDGFMSVFRQRQCGTQTAQTAADNAGFGFQTALEFRINSMRINRTKIIRRQIFLKIRANHCVCFIGYIFGRNDTDCRAISSKQKIG

SEQ ID NO: 964 - protein, 382 aa, Neisseria
  VARIANT (1)...(382): Xaa = Any Amino Acid
MRDKVGGNVALPAPRIFDFDIGKLRKNFKHILADKLGHTLRIVDKLVILTAEKQSAVRAEAVIIQNMAVVAYCHIVTDKPFCARPQGFGRNNKGADSNRLAFQRPEYRVQTCISIDSIDHIFALDAAFGRVNQPTVLMRFDARHRGLLENLRTGFGSGTSDAQSVSERMQVSGXGVELCPLVHIAVKLLFQLGFIPKLIMTRTVMPLGVFMPLLQLFPMLRTDGNRGITALPITIDGMFADAFVHQFDRLQRLLPKPLRLLQADLFFNFPHTAXVIADNLPATPSRRAETDTRGFQHNRFMSLLRQGQCSAQTTQSAADDTGIGFQTALKFRINSMRINRTEIIRRQIFLKIRANHCVCFIRCIFGRNDTGCRAISSXQKIG

SEQ ID NO: 965 - protein, 382 aa, Neisseria
MRDKVGGNVALPAPRIFDFDIGKLRKNFKHILADKLGHTRGIVDKLVILTAEKQSAVRAEAVIIQNMTVVAYCHIVADKPFCTRAQGFCGNNKGADSNRLALQRLEYRIQTGISIDGVHQIFAFDAAFGGVNQPTVLIRFNAYHGRMLKNLRTSFGSGAGDAQRVIERMEMPGQGIELCALVHIAVKLLLQFSVIPELIMSCTVIFLGVLMPLLQFFPMLRTDGNRGITALPIAINGMFADAFVHQFDRLQRLLPKPLRLLQTDLFFNFLHTAGVIADNLPATPSRRAETDTRGFQHNRFMSLLRQGQCSAQTTQSAADDTGIGFQTALKFRINSMRINRTEIIRRQIFLKIRANHCVCFIGYIFGRNDTGCRAISSKQKIG

SEQ ID NO: 966 - protein, 498 aa, Neisseria; identical to SEQ ID NO: 117

SEQ ID NO: 967 - protein, 483 aa, Neisseria; identical to SEQ ID NO: 114

SEQ ID NO: 968 - protein, 385 aa, Neisseria
MNLPIQKFMMLFAAAISLLQIPISHANGLDARLRDDMQAKHYEPGGKYHLFGNARGSVKNRVYAVQTFDATAVGPILPITHERTGFEGIIGYETHFSGHGHEVHSPFDNHDSKSTSDFSGGVDGGFTVYQLHRTGSEIHPEDGYDGPQGSDYPPPGGARDIYSYYVKGTSTKTKSNIVPRAPFSDRWLKENAGAASGFFSRADEAGKLIWESDPNKNWWANRMDDIRGIVQGAVNPFLMGFQGVGIGAITDSAVSPVTDTAAQQTLQGINHLGNLSPEAQLAAATALQDSAFAVKDGINSARQWADAHPNITATAQTALAVAEAATTVWGGKKVELNPTKWDWVKNTGYKTPAVRTMHTLDGEMAGGNRPPKSITSNSKADASTQ

SEQ ID NO: 969 - protein, 255 aa, Neisseria
MFHHKGIARNRRMEVLFFCRRPDRFVIRQTRLLQPHLRIILLQGDFLFFRLVQSCEVEPVLVLLHHNGKSGNAHRKQQKEIRFVHCRSDVFLCYYSGIGPAVRSATRKTALLALGLAAISASPGFNALPTIFRGGSGKSASLTAAQLGRGSCCEYFLTNCFTMRSSNEWKAMTAKRPPSFRRHMTCGNTAPTSSSSRLIKMRIAWKVRVAGSCPRSRVRTFCATICASLRVVSIGLSARCATMARTIWRLNRSSP

SEQ ID NO: 970 - protein, 255 aa, Neisseria
  VARIANT (1)...(255): Xaa = Any Amino Acid
MLHHKGXARNRXMEVLFFCRRPDRFVVRQTRLLQPHLRIILLQGDFLFFRLIQSCEIEPVLVLLHHNGKSGNAHRKQQKEIQFVHCHSDVFLCDCSGIGPAVRSATRKTALLALGLAAISASPGFNALPTIFRGSSGKSASLTAAQRGRGACCEYFLTNCFTMRSSNEWKAMTAKRPPSFRRHMTCGNTAPTSSSSRLIKMRTAWKVRVAGSCPRSRVRTFCATICASLRVVSIGLSARCATMARAIRRLNRSSP

SEQ ID NO: 971 - protein, 255 aa, Neisseria
MLHHKGIARNRRMEVLFFCRRPDRFVVRQTRLLQPHLRIILLQGDFLFFRLIQSCEVEPVLVLLHHNGKSGNAHRKQQKEIQFVHCHSDVFLCDCSGIGPAVRSATRKTALLALGLAAISASPGFNALPAIFRGGSGKSASLTAAQRGRGACCEYFLTNCFTMRSSNEWKAMTAKRPPSFRRHMTCGNTAPTSSSSRLIKMRIAWKVRVAGSCPRSRVRTFCATICASLRVVSIGLSARCATMARAIWRLNRSSP

SEQ ID NO: 972 - protein, 220 aa, Neisseria
MIEVIHFFGAETRRQFACADVGRFLHNAAHIQRGVNMGIIAHGRRSDFIRLRIQPFVQIGFARIQCLRNHERFDCRTRFDHIGYGTVAPLFAVCPAGSVGIVGGRIGQGEDFPRAGIQNHHRSGFCLMVFDRLVQLFIGQGLNPLIEGKDDVFAVLRCFIARGVQAVHNIALPVPQNNFRAVFAIQAVFKRKFQTFLTFAVNIGKSDDVCKQVAHRVMAF

SEQ ID NO: 973 - protein, 219 aa, Neisseria
  VARIANT (1)...(219): Xaa = Any Amino Acid
MIEVIHFFGTETRRQFACADVGRFLHDAAHIQRGVNMGIAHGRRSDFIRLRIQPFVQIGFARIQCLRNHKRFDCRTGFDHIGYGTVAPLFAVCPAGPVGIVGGRIGQGEDFPRAGIQXHHRSGFCLMVFDRLVQLFIGQGLNPLIEGKDDVFAVFRGFXARGVQAVHNIALPVPQNDFRAVFAMQAVFKRKFQTFLTFAVNIGKSDDVCKQVAHRVMAF

SEQ ID NO: 974 - protein, 219 aa, Neisseria
MIEVIHFFGTETRRQFACADVGRFLHDAAHIQRGVNMGIAHGRRSDFIRLRIQPFVQIGFARIQCLRNHKRFDCRTGFDHIGYGTVAPLFAVCPAGPVGIVGGRIGQGEDFPRAGIQNHHRSGFCLMVFDRLVQLFIGQGLNPLIEGKDDVFAVFRGFIARGVQAVHNIALPVPQNDFRAVFAMQAVFKRKFQTFLTFAVNIGKSDDVCKQVAHRVMAF

SEQ ID NO: 975 - protein, 267 aa, Neisseria
MPTRPTRAANPPTPTTWLQTAYCPRPPYRPPSVQTHTPHEPASSTCAAKSANRRENSHNAQPTYLLHPSNKMPSETEQTLFRRHQIPPSCRQSVVVMTVRTVDMTVCDFLIGCIAHAFNRSFKADFHACQRMVAVHHRLAVGNIGYTIDDNIAGFRIVRFKHHTDLDFNRERARIFNTDQLRIMLTERIVGRKRHFDRIAGILTVQRLFHQRENAVVTAVQIRNRFFGFIQKLIVGIIHLIMQRNHGIFCNSHICPFRNSRLITGAF

SEQ ID NO: 976 - protein, 177 aa, Neisseria
RQSVVVMTVRAVDMTVCDFLIGCIAHAFNCSLKADFHACQRMVAVHHRLAVGNIGYTIDDNIAGFRIVGFKHHADFDFNREHARIFDTDQLRILLAERIVGRQRHIDRIAGILTVQRLFHQRENAVVTAVQIRNRFFGFVQKLIVGIIHLIMQRNHGIFHDSHICPFRNSRLITGAF

SEQ ID NO: 977 - protein, 267 aa, Neisseria
MPTRPTRAAKHPTPPTWLQTAYCPRPPYRPPSVQTHTPHEPASSTCAAKSANRRENFHNAQPTYLLHPSNKMPSEMEQTLFRRHQIPPSCRQSVVVMTVRTVDMTVCDFLIGCIAHTFNRSLKADFHACQRMVAVHHRLTVGNIGYTIDDNIAGFRIVGFKHHADFDFNREHARIFNTDQLRILLAERIVGRKRHIDRIAGILTVQRLFHQRENAVVTAVQIRNRFFGFVQKLIVGIIHLIMQRNHGILHDSHICPFRNSRLITGAF

SEQ ID NO: 978 - protein, 267 aa, Neisseria; identical to SEQ ID NO: 975

SEQ ID NO: 979 - protein, 267 aa, Neisseria
MPTRPTRAANPPTPPTWLQTAYCPRPPYRPPSVQTRTPREPASSTCAAKSANRRENSHNAQPTYLLHPSNKMPSETEQTLFRRHQIPPSCRQSVVVMTVRAVDMTVCDFLIGCIAHAFNCSLKADFHACQRMVAVHHRLAVGNIGYTIDDNIAGFRIVGFKHHADFDFNREHARIFDTDQLRILLAERIVGRQRHIDRIAGILTVQRLFHQRENAVVTAVQIRNRFFGFVQKLIVGIIHLIMQRNHGIFHDSHICPFRNSRLITGAF

SEQ ID NO: 980 - protein, 267 aa, Neisseria; identical to SEQ ID NO: 977

SEQ ID NO: 981 - protein, 289 aa, Neisseria
MIGELVVLFVIEHFKQRAGGIAPKVAAQFVDFVEQEQRVSYACFCHILQNLAGHRADIGTAVPADFAFVAHAAQGHTDIFPPRCFGDGFAQRGFAHARRADQTQNRTFELVHTFLDGEVFQNPFFDFFQAVVVGIQHQSGFGDVFADAGFFLPRQSEQGVDVVAYDGGFGRHRRHHFEFFQFGQAFFFRFFGHTRLFDACLQGIQFAVFVFFAQFFVYRFNLFVQIIFALGFFHLAFDASAYAFFGLHNVEFGFQLCQQEFHPFADFGNLQNLLALRQFQLQMRCDRIG

SEQ ID NO: 982 - protein, 289 aa, Neisseria
MIGKLVVLFGIEHFEQRAGGIASEVVTQFVDFVEQEQGVFHAGFCHILQNLTGHRADIGAAVSPDFAFVAHAAQSHADIFPPRCFGDGFAQRGFAHARRADQAQNRAFEFVHTFLDGEVFQNPFFDFFQAVVVGIQHQSGFGDVFADAGFFLPRQLEQSVDVVAYDGGFRRHRWHHFELFQFGQAFFFRFFGHTRLFDICFQGIQFAVFVFFAQFFVYRFNLFVQIIFALGFFHLAFDASAYAFFGLHNVEFGFQLCQQEFHPFADFGNFQNLLALRQFQLQMRCDRIG

SEQ ID NO: 983 - protein, 289 aa, Neisseria
  VARIANT (1)...(289): Xaa = Any Amino Acid
MIGELVVLLGIKHFEQRAGGIAPEVAXQFVDFVEQEQWVFYAGFCHILQNLTGHGADIGAAVSPDFAFVAHAAQSHADIFPPRCFGDGFAQRGFAHAWRADQAQNRAFEFVHTFLDGEVFQNPFFDFFQAVVVGIQHQSGFGDVFADAGFFLPRQFEQGVDVVAYDGGFGRHRRHHFELFQFGQAFFFRFFGHTRLFDICFQGIQFAVFVFFAQFFVYRFNLFVQIIFALGFFHLAFDASAYAFFGLHNVEFGFQLCQQEFHPFADFGNFQNLLALRQFQLQMRCDRIG

SEQ ID NO: 984 - protein, 110 aa, Neisseria
MVIVWLPELPPMPATMGISAASATIFSILPSNAPMTRLARKAVQRLTASHIQRFLTESKTGANRSSSSCKPAMFNISASDSSRITSTISSMVILPMSFLFSSTTGAVTKS

SEQ ID NO: 985 - protein, 110 aa, Neisseria
  VARIANT (1)...(110): Xaa = Any Amino Acid
MVIVWLPELPPMPATMGISAXSATIFSMLPSNAPITRLARKAVQRLTASHIQXFFTESHTGANRSSSSCKPAIFSISASDSSRITSTISSMVILPMSFLFSSTTGAVTKS

SEQ ID NO: 986 - protein, 110 aa, Neisseria
MVIVWLPELPPMPATMGISAASATIFSMLPSNAPITRLARKAVQRLTASHIQRFLTESKTGANKSSSSCKPAIFNISASDSSRITSTISSTVTLPMSFLFSSTTGAVTKS

SEQ ID NO: 987 - protein, 277 aa, Neisseria
MPPEARPAGSDGIAALLRSVYTQNALQEINQIIPQTPSGFLPCHRNHSRAQHTVGQGITLLHHTNHGIGFLLTGHRLHRLMDIRIELIARFRIDFLDLRGIKRLLQLIQSHLHTHFQRIEITALIQKRHFQIILDRQHFHGKLLSGELVRIGNFLLVAAAQVLLVCQSAQLFVFQLRFQLGNPRLQILISRLGGSLFLYTVRISYCLDGFHRLHIFNRFFTVLLLCLFAHIVSLKTNWKSKSGYYPSKIRTFSRNFKQRQEISHPPPNTLPQKPYKR

SEQ ID NO: 988 - protein, 276 aa, Neisseria
  VARIANT (1)...(276): Xaa = Any Amino Acid
MPSEARQAGSDGIAALLRSVYTQNALQEINQIIPQTPSGFLLRHRNHSRAQHAVGQRITLLHHTHHGIRLLFACHRLHRLMDIRIELIARFRVDFLDLRSIKCFLQLVQSHLHAHFQRIEIAALIQKRHFQIILDRQHFHGKLLSGELVRIRNFLLVAAAQVLLVCQSALLVFQLRFQLGNPRLQILISRLCGSLFLHTVRISYCFDGFHRLHIFNRFFTVLLLCLFAHIVSLKTNWKSKSSYYPRKIRTFSRNFXQXQRISNSFSNPLPKKXYRR

SEQ ID NO: 989 - protein, 276 aa, Neisseria
MPSEARQAGSDGIAALLRSVYTQNALQEINQIIPQTPSGFLLCHRNHSRAQHAVGQRITLLHHAHHGIGFLFACHRLHRLMDIRIELIARFRIDFLDLRSIKCFLQLVQSHLHAHFQRIEIAALIQKRHFQIILDRQHFHGKLLSGELVRIRNFLLVAAAQVLLVCQSAQLLVFQLRFQLGNPRLQILISRLCGSLFLHTVRISYCLDGFHRLHIFNRFFTVLLLCLFAHIVSLKTNWKSKSSYYPRKIRTFSRNFKQRQRISNSFSNPLPKKYRR

SEQ ID NO: 990 - protein, 277 aa, Neisseria; identical to SEQ ID NO: 987

SEQ ID NO: 991 - protein, 272 aa, Neisseria
  VARIANT (1)...(272): Xaa = Any Amino Acid
MPSEARQAGSDGIAALLRSVYTQNALQEINQIIPQTPSGFLLRHRNHSRAQHAVGQRITLLHHTHHGIRLLFACHRLHRLMDIRIELIARFRVDFLDLRSIKCFLQLVQSHLHAHFQRIEIAALIQKRHFQIILDRQHFHGKLLSGELVRIRNFLLVAAAQVLLVCQSALLVFQLRFQLGNPRLQILISRLCGSLFLHTVRISYCFDGFHRLHIFNRFFTVLLLCLFAHIVSLKTNWKSKSSYYPRKIRTFSRNFXQXQRISNSFSNPLPKK

SEQ ID NO: 992 - protein, 273 aa, Neisseria
MPSEARQAGSDGIAALLRSVYTQNALQEINQIIPQTPSGFLLCHRNHSRAQHAVGQRITLLHHAHHGIGFLFACHRLHRLMDIRIELIARFRIDFLDLRSIKCFLQLVQSHLHAHFQRIEIAALIQKRHFQIILDRQHFHGKLLSGELVRIRNFLLVAAAQVLLVCQSAQLLVFQLRFQLGNPRLQILISRLCGSLFLHTVRISYCLDGFHRLHIFNRFFTVLLLCLFAHIVSLKTNWKSKSSYYPRKIRTFSRNFKQRQRISNSFSNPLPKK

SEQ ID NO: 993 - protein, 169 aa, Neisseria
MYGRNGSTQAAVAFVFDQTQRARFGNGEVYAAQADIGSAVNIAQGFAGESGQLVHVVCKRCAEVLVEQFADLFFGFMDCGHHDMGRFFACHLDDKLAQVAFHRLNAFCFKIMVQLDFFADHGFAFDHQLAVFGCDDVVDNLAGFGRGFRPVYFHAQLSQVFFQLLQQRG

SEQ ID NO: 994 - protein, 150 aa, Neisseria
  VARIANT (1)...(150): Xaa = Any Amino Acid
MHGRYGGTQATVAFVFHQTQRTCFSNGKVYATQTDIGSAVNIAQCFTGEAGQLVYIVCQRRTEVLVEQFANLFFGFVDSRHHDMGRFFACHLDDELAQVAFYRFNAFCFKIMXQLDFLADHRFAFDHQLAVFGCDDVVDNLAGFGRGFCP

SEQ ID NO: 995 - protein, 166 aa, Neisseria
MHGRNGGTQATVAFVFHQTQRTCFSNGEVHATQTDIGSAVNIAQCFTGEAGQLVYVVRRCAEVLVEQFANLFFGFMDCGHHDMGRFFTCHLDDELAQVAFHRFNAFCFKIMVQLDFLADHRFAFDHQLAVFGCDDVVDDFAGFGRCFRPVYFYAQLGQVFFQLLQQ

SEQ ID NO: 996 - protein, 326 aa, Neisseria
MKRKMLNVPKGGYDGMKGFTIVEFLVAGLLSIIVLIAVVSSYFTSRKLNDVANERLAIQQDLRNAATLIVRDARMAGSFGCFNMSEHTKDDIVDSSNQTQSNLAKPGAKQENPLFSLKRSGMDKQLIPVAESIDIKYPGFIQRLNALVFQYGIDDLDASAETVVVSSCSKIAKPGKKISTLQEAKSALQITNDDKQNGNITRQKHVVNAYAVGRFGNNEESLFRFQLDDKGKWGNPQLLVKKVKRMDVRYIYVSGCPEDEDAGKEEKFRYTNKFDKSKNAVTPAGVEVLLDSGLNAKIAASSDNSIYAYRINATIRGGNVCANRTL

SEQ ID NO: 997 - protein, 225 aa, Neisseria
  VARIANT (1)...(225): Xaa = Any Amino Acid
XRRKMLNVXXGSYDGMKGFTIIEFLVAGLLSMIVLMAVGSSYFTSRKLNDAANERLAAQQDLRNAATLIVRDARMAGGFGCFNMSEHPATDVIPDTTQQNSPFSLKRNGIDKLIPIAESSNINYQNFFQVGSALIFQYGIDDVNASTATTVVSSCAAISKPGKQIPTLEDAKKELKIPDQDKEQNGNIARQRHVVNAYAVGRIADEESLFRFQLDDKGKWGNPQL

SEQ ID NO: 998 - protein, 332 aa, Neisseria
  VARIANT (1)...(332): Xaa = Any Amino Acid
MRRKMLNVPKGNYDGMKGFTIIEFLVAGMLSMIVLMAVGSSYFTSRKLNDAANERLSAQQDLRNAATLIVRDARMAGGFGCFNMSEHTKNDIIVDPSKQTQHVPVKPGAKQENPLFSLEWANTNNTNNNTAKLIPIAESTDIKYPGFAQARPALIFQYGIDDLDASAETVVVSSCSKIAKPGKKISTLQEAKSALQITNDDKQNGNITRQRHVVNAYAVGRIAGEEGLFRFQLDDKGKWGNPQLLVKKIRHMKVRYIYVSDCPEDDDAGKEEKFKYTGTFDSSTNAVTPAGVEVLLSXGTDTKIAASSDNHIYAYRIDATIRGGNVCANRTL

SEQ ID NO: 999 - protein, 221 aa, Neisseria
PGAKQENPLFSLKRSGMDKQLIPVAESIDIKYPGFIQRLNALVFQYGIDDLDASAETVVVSSCSKIAKPGKKISTLQEAKSALQITNDDKQNGNITRQKHVVNAYAVGRFGNNEESLFRFQLDDKGKWGNPQLLVKKVKRMDVRYIYVSGCPEDEDAGKEEKFRYTNKFDKSKNAVTPAGVEVLLDSGLNAKIAASSDNSIYAYRINATIRGGNVCANRTL

SEQ ID NO: 1000 - protein, 313 aa, Neisseria
MRRKMLNVPKGSYDGMKGFTIIEFLVAGLLSMIVLMAVGSSYFTSRKLNDAANERLAAQQDLRNAATLIVRDARMAGGFGCFNMSEHPATDVIPDTTQQNSPFSLKRNGIDKLIPIAESSNINYQNFFQVGSALIFQYGIDDVNASTATTVVSSCAAISKPGKQIPTLEDAKKELKIPDQDKEQNGNIARQRHVVNAYAVGRIADEEGLFRFQLDDKGKWGNPQLLVKKVRHMKVRYIYVSGCPEDDDAGKEETFKYTDKFDSAQNAVTPAGVEVLLSSGTDTKIAASSDNHIYAYRIDATIRGGNVCANRTL

SEQ ID NO: 1001 - protein, 205 aa, Neisseria
NNTAKLIPIAESTDIKYPGFAQARPALIFQYGIDDLDASAETVVVSSCSKIAKPGKKISTLQEAKSALQITNDDKQNGNITRQRHVVNAYAVGRIAGEEGLFRFQLDDKGKWGNPQLLVKKIRHMKVRYIYVSDCPEDDDAGKEEKFKYTGTFDSSTNAVTPAGVEVLLSSGTDTKIAASSDNHIYAYRIDATIRGGNVCANRTL

SEQ ID NO: 1002 - protein, 203 aa, Neisseria
MRKQNTLTGIPTSDGQRGSALFIVLMVMIVVAFLVVTAAQSYNTEQRISANESDRKLALSLAEAALREGEFQVLDLEYAADSKVTFSENCEKGLCTAVNVRTNNNGSEEAFGNIVVQGKPAVEAVKRSCPAKSGKNSTDLCIDNKGMEYNKGAAGVSKMPRYIIEYLGVKNGQNVYRVTAKAWGKNANTVVVLQSYVGNNDEQ

SEQ ID NO: 1003 - protein, 180 aa, Neisseria
  VARIANT (1)...(180): Xaa = Any Amino Acid
GFALLIVLMVXIVVAFXXVTAAQSYNTEQRISXNESDRKLAXSLAEXXXREGELQVLDLEYDTDSKVTFSENCGKGLXAAVNVRTNNDNEEAFDNIVVQGKPTVEAVKRSCPANSTDLCIDKKGXEYKKGTRSVTKMPRYIIEYLGVXNGENVYRVTAKAWGKNANTVVVLQSYVSNNDE

SEQ ID NO: 1004 - protein, 197 aa, Neisseria
MRKQNTLTGIPTSDGQRGFALFIVLMVMIVVAFLVVTAAQSYNTEQRISANESDRKLALSLAEAALREGELQVLDLEYDTDSKVTFSENCGKGLCTAVNVRTNNDNEEAFDNIVVQGKPTVEAVKRSCTAKSTGLCIDNKGMEYKKGTQSVSKMPRYIIEYLGVKNGENVYRVTAKAWGKNANTVVVLQSYVSNNDE

SEQ ID NO: 1005 - protein, 197 aa, Neisseria
MRKQNTLTGIPTSDGQRGFALFIVLMVMIVVAFLVVTAAQSYNTEQRISANESDRKLALSLAEAALREGELQVLDLEYDTDSKVTFSENCGKGLCAAVNVRTNNDNEEAFDNIVVQGKPTVEAVKRSCPANSTDLCIDKKGMEYKKGTRSVSKMPRYIIEYLGVKNGENVYRVTAKAWGKNANTVVVLQSYVSNNDE

SEQ ID NO: 1006 - protein, 203 aa, Neisseria
MKNNDCLRLKNPQSGMALIEVLVAMLVLTIGILALLSVQLRTVASVREAETQTIVSQITQNLMEGMLMNPTIDLDSNKKNYSLYMGKQTLSAVDGEFMLDAEKSKAQLAEEQLKRFSHELKNALPDAVAIHYAVCKDSSGDAPTLSDSGAFSSNCDNKANGDTLIKVLWVNDSAGDSDISRTNLEVSGDNIVYTYQARVGGRE

SEQ ID NO: 1007 - protein, 202 aa, Neisseria
  VARIANT (1)...(202): Xaa = Any Amino Acid
MKNNDCFRLKDSQSGMALIEVLVAMLVLTIGILALLSVQLRTVXXXXXXXXXXXXXXXXXXLMEGMLMNPTIDSDSNKKNYNLYMGNHTLSAVDGDFAIDAMKTKGQLAEAQLKRFSYELKNALPDAAAIHYAVCKDSSGNAPTLSGNAFSSNCDNKANGDTLIKVLWVNDSAGDSDISRTNLEVSGDNIVYTYQARVGGRE

SEQ ID NO: 1008 - protein, 204 aa, Neisseria
MKNNDCFRLKNPQSGMALIEVLVAMLVLTIGILALLSVQLRTVASVREAETQTIVSQITQNLMEGMLMNPTIDSDSNKKNYNLYMGNHHALSVVDGDFQVDAIKTKTQLAEAQLKRFSYELKNALPDAAAIHYAVCKDSSGVAPTLSAGSTFSSNCDGSANGDTLIKVLWVNDSAGDSDIARTNLETNGNNIVYTYQARVGGRE

SEQ ID NO: 1009 - protein, 202 aa, Neisseria
MKNNDCFRLKDSQSGMALIEVLVAMLVLTIGILALLSVQLRTVASVREAETQTIVSQITQNLMEGMLMNPTIDSDSNKKNYNLYMGNHTLSAVDGDFAIDAMKTKGQLAEAQLKRFSYELKNALPDAAAIHYAVCKDSSGNAPTLSGNAFSSNCDNKANGDTLIKVLWVNDSAGDSDISRTNLEVSGDNIVYTYQARVGGRE

SEQ ID NO: 1010 - protein, 113 aa, Neisseria
MTHTASPRDEFIRGIKESSPMLIGLLPWALILGMQGGQKGMGRLEMLLMTGMNFAGGSEFATVNLWAEPLPILLIATITFMINSRHILMGGGACHAHERNTAEKSRARAVFYV

SEQ ID NO: 1011 - protein, 112 aa, Neisseria
MHTPSPHNEFIRGIKESSPMLIGLLPWALILGMQGGQKGMSWLEMLLMTSMNFAGGSEFATVNLWAEPLPILLIATVTFMINSRHILMGGGACPAPERNTAEKSRARTVFYV

SEQ ID NO: 1012 - protein, 113 aa, Neisseria
  VARIANT (1)...(113): Xaa = Any Amino Acid
MTHISSPRNEFIRGIKESSPMLIGLLPWALILGMQGGQKGMSWLEMLLMTGMNFAGGSEFATVNLWAEPLPILLIATVTFMINSRHILMGXGTCPAPERNTAEKSRARTVFYV

SEQ ID NO: 1013 - protein, 244 aa, Neisseria
MPDPIGILFAAVGVDFFAVVLRGRFQRIGAVGMLIIIILMAEVGTKTVVTEVDAQVVADFGGIEGFFECRLQEPVAFPVNHAVGFVVGRRLVGTRAAIFVRTVGGTVRLLKMIVQTDALPVVREAGIIRPSVFIGIGIDIFQTVAAFGVRLVVKHARTVFRAHLRTVFTVGNQPAVFAAARVFAVASYRSVFFIFIKNRLGQECRNRHIARVESLLRAFEYAADVVPFVFKTKTRAEQPRPAFV

SEQ ID NO: 1014 - protein, 304 aa, Neisseria
MRAAVVVAQARADIRPPAQTDIVPNCRVIAFTVDAARRAVRISIVAQAADLPRNDISPAYGDPIGAGFTAVGADFFAVVLRGRVRRIGAVGMLIIIILMAEIRAKAVKPEIHAQVVADFGGIEGFFECRLQEPVAFPVNHAIGFVIGKRLVGTRAAIFVRTVGRTVRLLKMIIQTDALPVVREAGIIRPSVFIGIGIDIFQTVAAFGVRLVVKHARTVFRAHQRTVFAVGKQSAVFVVARVFAVTGQRTRLFFICIKNRLGQECRNRHIARVESLLRVFEYAADVVPLILKTKTRAEQPRPAFV

SEQ ID NO: 1015 - protein, 299 aa, Neisseria
MRAAVVVAQPRADIRPPAQTDIVPNCRVIAFAVDAARRAVRISIVAQAADLPRNHISPAYADPIGLVLAAVGVGGFRGRFRRIGAVGMLIIIILMAEIRVKAVKTEIHAQVVADFGGIEGFFECRLQEPVAFPVNHAVGFVVGKRLVGTRAAIFVRTVGRTVRLLKMIVQTDALPVVREAGIIHPSVFIGIGIDIFQTVAAFGVRLVVKHARTVFRAHQRTVFAVGKQTAVFVVARVFAVASYRSVFSIFIKNRLGQECRNRHIARVESLLRVFEYAADVVPFVFKTKTRAEQPRSAFV

SEQ ID NO: 1016 - protein, 397 aa, Neisseria; identical to SEQ ID NO: 133

SEQ ID NO: 1017 - protein, 397 aa, Neisseria
MIDRNRMLRETLERVRAGSFWLWVVAATFAFFTGFSVTYLLMDNQGLNFFLVLAGVLGMNTLMLAVWLAMLFLRVKVGRFFSSPATWFRGKDPVNQAVLRLYADEWRQPSVRWKIGATSHSLWLCTLLGMLVSVLLLLLVRQYTFNWESTLLSNAASVRAVEMLAWLPSKLGFPVPDARAVIEGRLNGNIADARAWSGLLVGSIACYGILPRLLAWVVCKILLKTSENGLDLEKPYYQAVIRRWQNKITDADTRRETVSAVSPKIILNDAPKWAVMLETEWQDGEWFEGRLAQEWLDKGVATNREQVAALETELKQKPAQLLIGVRAQTVPDRGVLRQIVRLSEAAQGGAVVQLLAEQGLSDDLSEKLEHWRNALAECGAAWLEPDRAAQEGRLKDQ

SEQ ID NO: 1018 - protein, 400 aa, Neisseria
MIDRNRMLRETLERVRAGSFWLWVAAATFAFFTGFSVTYLLMDNQGLNFFLVLAGVLGMNTLMLAVWLAMLFLRVKVGRFFSSPATWFRGKDPVNQAVLRLYADEWRQPSVRWKIGATSHSLWLCTLLGMLVSVLLLLLVRQYTFNWESTLLGDSSSVRLVEMLAWLPAKLGFPVPDARAVIEGRLNGNIADARAWSGLLVGSIACYGILPRLLAWAVCKILLKTSENGLDLEKPYYQAVIRRWQNKITDADTRRETVSAVSPKIVLNDAPKWAVMLETEWQDGEWFEGRLAQEWLDKGVAANREQVAALETELKQKPAQLLIGVRAQTVPDRGVLRQIVRLSEAAQGGAVVQLLAEQGLSDDLSEKLEHWRNALTECGAAWLEPDRAAQEGRLKTNDRT

SEQ ID NO: 1019 - protein, 208 aa, Neisseria
MYAGERFNTYSHLSGLILAAAGLMLMLLKTIGHGDGYRIFSVSVYGISLLLLYLSSSLYHGIAAGKLKSILKKTDHCMIYVLIAGSYTPFALVSLRNGPGWTVFSLSWLLAAAGIAQELTIGRKSEKRLLSIAIYIVMGWMVLAVMKSLTASLPPAGLAWLAAGGMLYSVGIYWFVNDEKIRHGHGIWHLFVLGGSITQFVSVYGYVI

SEQ ID NO: 1020 - protein, 167 aa, Neisseria
VSVYGISLLLLYLSSWLYHGIAAGKLKSILKKTDHCMIYVLIAGSYTPFALVSLRNGPGWTVFSLSWLLAAAGIAQELTIGRKSEKRLLSIVIYVVMGWMVLAVMKSLTASLPSAGLAWLAAGGMLYSVGIYWFVNDEKIRHGHGIWHLFVLGGSITQFVSVYGYVI

SEQ ID NO: 1021 - protein, 208 aa, Neisseria
MYTGERFNTYSHLSGLILAAAGLALMLLKTIGHGDGYRIFSVSVYGISLLLLYLSSSLYHGIAAGKLKSILKKTDHCMIYVLIAGSYTPFALVSLRNGPGWTVFSLSWLLAAAGIAQELTIGRKSEKRLLSIAIYIVMGWMVLAVMKSLTASLPPAGLAWLAAGGMLYSVGIYWFVNDEKIRHGHGIWHLFVLGGSITQFVSVYGYVI

SEQ ID NO: 1022 - protein, 188 aa, Neisseria
MVGQEALRGQFVAVFAAALRYAVKTCADFHAFDGVDAHHRVGDFGIEAVENGFAQTDGDVGGFDMQFRADGIQGFAHTVHIVFQFGDLALVGGKKRILGNVFAAFKPDFFFADLGNVGGDFRAEFFFQPFFGNGSGGNAGCGFAGGTPAAAPVVARTVFVPIGIVGVSGAEGGGDVAVVFAALVGVAD

SEQ ID NO: 1023 - protein, 188 aa, Neisseria
VVGQEALRGQFVAVFAAALRYAVKTCADFHAFDGVDAHHRVGDFGIEAVKNRFAQADRDIGCFDMQLRADGIQGFAHAVHIVFQLGNLAMVGGKKRILGNVFAAFKPDFFFADLGNVGGDFRAEFFFQPFFGNGSGSNAGGGFTGGAPAAAAVVARAVFVPIGIVGVAGAEAGGDVAVVFAALVGIAD

SEQ ID NO: 1024 - protein, 188 aa, Neisseria
VVGQEALRGEFVAVFAAALRYAVKTCADFHAFDGVDAHHGVGDFGIEAVEYGFAQADGDVGGFNMQLRADGIQGFAHAVHIVFQLGNLAMVGGKKRILGNVFAAFKPDFFFADLGNVGGDFRAEFFFQPFFGNGSGGNAGGGFAGGTPAAAPVVARAVFVPIGIVGVAGAEAGGDVAVVFAALVGIAD

SEQ ID NO: 1025 - protein, 239 aa, Neisseria
MLAVRNRGWHGAVVHFRSCGGVANTAPVFYHLGDTAEIAFALDTLTARYREIYAVGVSLGGNAPAKYLGEQGKKALPHASAAVSAPVDAEAAGSRFDSGITRLLYTRYFLRTLIPKARSLQGFQTAFAAGCKTLGEFDDRFTAPLHGFADRHDYYRQTSCKPLLKHVAKPLLLLNAANDPFLPPEALPRADEASEAVTLFQPAHGGHAGFVSSTGGRLHLQWLPQTVLSYFDSFRTNRR

SEQ ID NO: 1026 - protein, 239 aa, Neisseria
  VARIANT (1)...(239): Xaa = Any Amino Acid
MLAVRDRGWHGVVVHFRSCGGIANTAPVFYXLGDTAEIAFTLDTFAARYREIYAVGVSLGGNALAKYLGEQGKKALPQAAAVISAPVDAEAAGRRFDSGITRLLYTRYFLRTLIPKAKSLQGFQTAFAAGCKTLGEFDDRFTAPLHGFADRHDYYRQTSCKPLLKHVAKPLLLLNAVNDPFLPPEALPRADEVSEAVTLFQPAYGGHVGFVSSTGGRLHLQWLPQTVLSYFDSFRTNRR

SEQ ID NO: 1027 - protein, 239 aa, Neisseria
MLAVRDRGWNGVVVHFRSCGGVANTAPVFYHLGDTAEIAFTLDTLAARYREIYAVGVSLGGNALAKYLGEQGENALPQAAAVISAPVDAEAAGNRFDSGITRLLYTRYFLRTLIPKARSLQGFQTAFAAGCKTLGEFDDRFTAPLHGFADRHDYYRQTSCKPLLKHVAKPLLLLNAVNDPFLPPEALPRADEVSEAVTLFQPTHGGHVGFVGSTGGRLHLQWLPQTVLSYFDSFRTNRR

SEQ ID NO: 1028 - protein, 319 aa, Neisseria
MILTPPDTPFFLRNGNADTIAAKFLQHPAPAYRREMLPDSTGKTKTAYDFSAGGISPDAPLVVLFHGLEGSSRSHYAVELMLAVRNRGWHGAVVHFRSCGGVANTAPVFYHLGDTAEIAFALDTLTARYREIYAVGVSLGGNAPAKYLGEQGKKALPHASAAVSAPVDAEAAGSRFDSGITRLLYTRYFLRTLIPKARSLQGFQTAFAAGCKTLGEFDDRFTAPLHGFADRHDYYRQTSCKPLLKHVAKPLLLLNAANDPFLPPEALPRADEASEAVTLFQPAHGGHAGFVSSTGGRLHLQWLPQTVLSYFDSFRTNRR

SEQ ID NO: 1029 - protein, 318 aa, Neisseria
MILTPPDTPFFLRNGNADTIAAKFLQRPAPAYRRELLPDSTGKTKVAYDFSDGISPDAPLVVLFHGLEGSSRSHYAVELMLAVRDRGWHGVVVHFRSCGGIANTAPVFYHLGDTAEIAFTLDTFAARYREIYAVGVSLGGNALAKYLGEQGKKALPQAAAVISAPVDAEAAGRRFDSGITRLLYTRYFLRTLIPKAKSLQGFQTAFAAGCKTLGEFDDRFTAPLHGFADRHDYYRQTSCKPLLKHVAKPLLLLNAVNDPFLPPEALPRADEVSEAVTLFQPAYGGHVGFVSSTGGRLHLQWLPQTVLSYFDSFRTNRR

SEQ ID NO: 1030 - protein, 318 aa, Neisseria
MILTPPDTPFFLRNGNADTIAAKFLQRSAPAYRRELLPDSTGKTKTAYDFSDGISPDAPLVVLFHGLEGGSGSHYAVELMLAVRDRGWNGVVVHFRSCGGVANTAPVFYHLGDTAEIAFTLDTLAARYREIYAVGVSLGGNALAKYLGEQGENALPQAAAVISAPVDAEAAGNRFDSGITRLLYTRYFLRTLIPKARSLQGFQTAFAAGCKTLGEFDDRFTAPLHGFADRHDYYRQTSCKPLLKHVAKPLLLLNAVNDPFLPPEALPRADEVSEAVTLFQPTHGGHVGFVGSTGGRLHLQWLPQTVLSYFDSFRTNRR

SEQ ID NO: 1031 - protein, 126 aa, Neisseria
MGRHFGRRRFLTAAAVAVAGAAVSFLPNPFAAGGEKRNMDKKRDENVFFWKGVALGSGAELRLFGVDDRQAADLVNKVLAEVARLEKMFSLYREDSLISRLNRDGYLTSPPADFLELLSLAAIFTR

SEQ ID NO: 1032 - protein, 126 aa, Neisseria
  VARIANT (1)...(126): Xaa = Any Amino Acid
MGRHFGXQRFLTVAAVAAGXAAVSFLPNPFAADDEKRNGDEKRNENVFFWKGVALGSGAXLRLFGVDDRRAADLVNKVLAEVARLEKLFSLYREDSLISRLNRDGYLTSPSADFLELXSLAAIFTX

SEQ ID NO: 1033 - protein, 126 aa, Neisseria
MGRHFGRRRFLTVAAVAAAGAAVSFLPNPFAADDEKRNKDEKRNENVFFWKGVALGSGAELRLFGVDDRRAADLVNKVLAEVARLEKMFSLYREDSLISRLNRDGYLTSPPADFLELLSLAVIFTR

SEQ ID NO: 1034 - protein, 400 aa, Neisseria; identical to SEQ ID NO: 159

SEQ ID NO: 1035 - protein, 588 aa, Neisseria
  VARIANT (1)...(588): Xaa = Any Amino Acid
MRRFLPIAAICAVVLLYGLTAATGSTSSLADYFWWIVAFSAMLLLVLSAVLARYVILLLKDRRDGVFGSQIAKRLSGMFTLVAVLPGVFLFGVSAQFINGTINSWFGNDTHEALERSLNLSKSALNLAADNALGNAVPVQIDLIGAASLPGDMGRVLEHYAGSGFAQLALYNAASGKIEKSINPHKLDQPFPGKARWEKIQRAGSVRDLESIGGVLYAQGWLSAGTHNGRDYALFFRQPVPKGVAEDAVLIEKARAKYAELSYSKKGLQTFFLATLLIASLLSIFLALVMALYFARRFVEPVLSLAEGAKAVAQGDFSQTRPVLRNDEFGRLTKLFNHMTEQLSIAKEADERNRRREEAARHYLECVLEGLTTGVVVFDEQGCLKTFNKAAEQILGMPLTPLWGSSRHGWHGVSAQQSLLAEVFAAIGAAAGTDKPVHVKYAAPDDAKILLGKATVLPEDNGNGVVMVIDDITVLIHAQKEAAWGEVAKRLAHEIRNPLTPIQLSAERXAXKLGGKLDEQDAQILTRSTDTIVKQVAALKEMVEAFRNYARSPSLKLENQDLNALIGDVLALYEAGPCRFAADLPANR

SEQ ID NO: 1036 - protein, 706 aa, Neisseria
MRRFLPIAAICAVVLLYGLTAATGSTSSLADYFWWIVAFSAMLLLVLSAVLARYVILLLKDRRDGVFGSQIAKRLSGMFTLVAVLPGVFLFGVSAQFINGTINSWFGNDTHEALERSLNLSKSALNLAADNALGNAIPVQIDLIGAASLPGDMGRVLEHYAGSGFAQLALYNAASGKIEKSINPHKLDQPFPGKARWEKIQQAGSVRDLESIGGVLYAQGWLSAGTHNGRDYALFFRQPVPKGVAEDAVLIEKARAKYAELSYSKKGLQTFFLATLLIASLLSIFLALVMALYFARRFVEPVLSLAEGAKAVAQGDFSQTRPVLRNDEFGRLTKLFNHMTEQLSIAKEADERNRRREEAARHYLECVLEGLTTGVVVFDEQGCLKTFNKAAEQILGMPLTPLWGSSRHGWHGVSAQQSLLAEVFAAIGAAAGTDKPVHVKYAAPDDAKILLGKATVLPEDNGNGVVMVIDDITVLIHAQKEAAWGEVAKRLAHEIRNPLTPIQLSAERLAWKLGGKLDEQDAQILTRSTDTIIKQVAALKEMVEAFRNYARSPSLKLENQDLNALIGDVLALYEAGPCRFAAELAGEPLMMAADTTAMRQVLHNIFKNAAEAAEEADVPEVRVKSEAGQDGRIVLTVCDNGKGFGREMLHNAFEPYVTDKPAGTGLGLPVVKKIIEEHGGRISLSNQDAGGACVRIILPKTVETYA

SEQ ID NO: 1037 - protein, 216 aa, Neisseria
MMMHASVQSRFAPILYVLIFFAGFLTAQIWFNQKAYTEELPPLLSALSAVALVWLAWAFVSVRSKAKAEKFYREKMIQNESIHPVLHASLQHLEHKPQMLALLVKNHGKGMAEQVRFKAEVLPDDEDARTIAAELAKMDMFALGTDAVASGETYGRVFADIFELSAALERRAFKGILKLTAEYKKHLRRCLPFGNGVGFGRAQSGVEGNLENAGKA

SEQ ID NO: 1038 - protein, 214 aa, Neisseria
  VARIANT (1)...(214): Xaa = Any Amino Acid
MMMHASVQSRFAPILYVLIFFAGFLTAQIWFNQKAYTEELPPLLSALSAVALVWLAWAFVSARSKAKAEKFYREKMIQNESIHPVXHASLQHLEHKPQILALLVKNHGKGMAEQVRFKAEVLPDDEDARTIAAELAKMDMFALGTDAVASGETYGRVFADIFELSXALEGRAFKGMLKLTAEYKXHLRRCLPFGNGVGVGRTQSGVAGDFKNIR

SEQ ID NO: 1039 - protein, 217 aa, Neisseria
  VARIANT (1)...(217): Xaa = Any Amino Acid
MMMHASVQSRFAPILYVLIFFAGFLTAQIWFNQKAYTEELPPLLSALSAVALVWLAWAFVSARSKAKAEKFYREKMIQNESIHPVLHASLQHLEHKPQMLALLVKNHGKGMAEQVRFKAEVLPDDEDARTIAAELAKMDMFALGTDAVASGETYGRVFADIFELSAALEGRAFKGMLKLTAEYKXHLRRCLPFGNGVGVGRAQSGVAGDFKNIGKVQ

SEQ ID NO: 1040 - protein, 169 aa, Neisseria
MMMHASVQSRFAPILYVLIFFAGFLTAQIWFNQKAYTEELPPLLSALSAVALVWLAWAFVSVRSKAKAEKFYREKMIQNESIHPVLHASLQHLEHKPQMLALLVKNHGKGMAEQVRFKAEVLPDDEDARTIAAELAKMDMFALGTDAVASGETYGRVFADIFELSAALE

SEQ ID NO: 1041 - protein, 221 aa, Neisseria
MMMHASVQSRFAPILYVLIFFAGFLTAQIWFNQKAYTEELPPLLSALSAVALVWLAWAFVSARSKAKAEKFYREKMIQNESIHPVLHASLQHLEHKPQILALLVKNHGKGMAEQVRFKAEVLPDDEDARTIAAELAKMDMFALGTDAVASGETYGRVFADIFELSAALEGRAFKGMLKLTAEYKNIFGDACRSETALELGALNQALQEISKTSEKSKRIFY

SEQ ID NO: 1042 - protein, 221 aa, Neisseria
MMMHASVQSRFAPILYVLIFFAGFLTAQIWFNQKAYTEELPPLLSALSAVALVWLAWAFVSARSKAKAEKFYREKMIQNESIHPVLHASLQHLEHKPQMLALLVKNHGKGMAEQVRFKAEVLPDDEDARTIAAELAKMDMFALGTDAVASGETYGRVFADIFELSAALEGRAFKGMLKLTAEYKNIFGDACRSETALELGALNQALQEISKTSEKSKRIFY

SEQ ID NO: 1043 - protein, 193 aa, Neisseria
MGAGVVFVVFQPFFSLFRALFEGGVGIVEGAHDAAECDFLSEEFTRIRIGDVFIDSVGQITARFFQAFGVNPGAFGVQQPAFRAREQARRGSGFFAGNDLRVLHKDAVEVDIDGGNTVSGHFLIRTDFDDGDAVCLFQAEARFAANVAQHQYLARINQVGIVDLIPVRAPQGGTIATGCTGICPKYPTGCRPV

SEQ ID NO: 1044 - protein, 171 aa, Neisseria
  VARIANT (1)...(171): Xaa = Any Amino Acid
MGAGMVFVVFRPFSSLFRALFEDRVGIVEGAHDAAECDFLPEEFTRIRIGDVFIDSVGQVAARLFQAFGVNPGAFGVQQPAFRARXXARXGSGFFAGNDLRMPHKDAVEVDIDGGNTVSGHFLIRTHFDDGDAVCLFQAEARFAVNVAQHQYLVRINQVGIVDLIPVRVPQ

SEQ ID NO: 1045 - protein, 193 aa, Neisseria
  VARIANT (1)...(193): Xaa = Any Amino Acid
MGAGMVFVVFRPFSSLFRALFEDRVGIVEGAHDAAECDFLPEEFTRIRIGDVFIDSVGQVAARLFQAFGVNPGAFGVQQPAFRAREQARRGSGFFAGNDLRVPHKDAVEVDIDGGNTVSGHFLIRTHFDDGDAVCLFQAEARFAVNVAQHQYLVQINQVGIVDLIPVRVPQAAXIATGCTGICPKCPTGCRPV

SEQ ID NO: 1046 - protein, 237 aa, Neisseria
MELGHIVFLVLCARSDGLFTFQTFRQPAFAQDTARAFAAAADDTLVAGVGLFADVVQHAHFVRQRPRLRLGQVHQRRVDLKIVVHRQIKGNVHGFDEHAAAVGIARKIGFAHARDDVPDTLPFGKNGGVKQEKRVTPVHKGIGNAVVGGFDGGGFDGGGFVHQGVVRNLPHQAQIEYGLTDTQILRDPLCAFQLDGMALPVSEGDGLDVFAPVGLDCLNQAGGRILTAREDDQGFLV

SEQ ID NO: 1047 - protein, 232 aa, Neisseria
MELGHIVFLMVCACSDGLFTFQIFRQPAFAQDTARAFAAAADDAVIAGVGLLADIVQHAHFVRQRPRLRLGQIHQRRVDLKIIVHRQIKGNVHRFDKHVAAVGIAGEVGFAHARDDVPYPLPFGVNRGIEQEKRVAAVYKGIRNAVFGSFDGGGVVHQGIVRNLPHQAQVEYGLFDAQILRNPAGTFQLDGMALPVLESNGLDVFAPVGLDCLNQAGGRILTARKDDQGLLV

SEQ ID NO: 1048 - protein, 232 aa, Neisseria
MELGHIVFLMVCACSDGLFTFQIFRQPAFAQDTARAFAAAADDAVIAGVGLLADIVQRAHFVRQRPSLRLGQIHQRRVDLKIIVHRQIKGNVHGFDKHVTAVGIAGEVGFAHARDDVPYPLPFGVNRGIEQEKRVAAVYKGIRNAVFGSFDGGGVVHQGIVRNLPHQAQVEYGLFDAQILRNPAGTFQLDGMALPVLESNGLDVFAPVGLDCLNQAGGRILTARKDDQGFLV

SEQ ID NO: 1049 - protein, 182 aa, Neisseria
MARLTVHTLETAPEAAKPRVEAVPKNNGFIPNLIGVLANAPEALAFYQEVGKLNAANSLTAGEVEVIRIIAVRTNQCSFCVAGHTKLATLKKLLSEQSLNAARALAAGKSDDAKLGALAAFTQAVMAKKGAVSDDELNAFLEAGYNRQQAVEVVMGVALATLCNYANNLAQTEINPKLQAYA

SEQ ID NO: 1050 - protein, 77 aa, Neisseria
  VARIANT (1)...(77): Xaa = Any Amino Acid
AAGEFDDAKLGALAAFTAVMAKKGAVSDEELKAFFDAGYNQQQAVEVVMGVXLATLCNYVNNLGQTEINPELQAYAX

SEQ ID NO: 1051 - protein, 182 aa, Neisseria
MARLTVHTLETAPEAAKARVEAVLQNNGFIPNLIGVLSNAPEALAFYQEVGKLNAANSLTAGEVEVIQIIAARTNQCGFCVAGHTKLATLKKLLSEQSVKAARALAAGEFDDAKLGALAAFTQAVMAKKGAVSDEELKAFFDAGYNQQQAVEVVMGVALATLCNYVNNLGQTEINPELQAYA

SEQ ID NO: 1052 - protein, 228 aa, Neisseria
LTLTRKTLFLLTAAFGTHSLQTASADAVVKPEKLHASANRSYKVAEFTQTGNASWYGGRFHGRKTSGGDRYDMNAFTAAHKTLPIPSHVRVTNTKNGKSVIVRVNDRGPFHGNRIIDVSKAAAQKLGFVSQGTAHVKIEQIVPGQSAPVAENKDIFIDLKSFGTEHEAQAYLNQAAQNFAASSSSPNLSVEKRRYEYVVKMGPFASQERAAEAEAQARGMVRAVLTSG

SEQ ID NO: 1053 - protein, 239 aa, Neisseria
LTLTRKTLFLLTAAFGTHSLQTASADAVVKAEKLHASANRSYKVAGKRYTPKNQVAEFTQTGNASWYGGRFHGRKTSGGERYDMNAFTAAHKTLPIPSYVRVTNTKNGKSVIVRVNDRGPFHGNRIIDVSKAAAQKLGFVNQGTAHVKIEQIVPGQSAPVAENKDIFIDLKSFGTEHEAQAYLNQAAQNFAVSSSGTNLSVEKRRYEYVVKMGPFTSQERAAEAEAQARGMVRAVLTAG

SEQ ID NO: 1054 - protein, 239 aa, Neisseria
LTLTRKTLFLLTAAFGIHSFQTASADAVVRAEKLHASANRSYKVAGKRYTPKNQVAEFTQTGNASWYGGRFHGRKTSGGERYDMNAFTAAHKTLPIPSYVRVTNTKNGKSVIVRVNDRGPFHGNRIIDVSKAAAQKLGFVNQGTAHVKIEQIVPGQSAPVAENKDIFIDLKSFGTEHEAQAYLNQAAQNLASSASNPNLSVEKRRYEYVVKMGPFASQERAAEAEAQARGMVRAVLTAG

SEQ ID NO: 1055 - protein, 123 aa, Neisseria
  VARIANT (1)...(123): Xaa = Any Amino Acid
MSVILPPTRANAAFSAWARLMILSCLLCWCAACPWSSSPCPSWWASAGAEMLSSAVAAEVKRRCLMFIXFAFVNRGLENVDINKVSNNRQPAVNTARTIPRAXASASAARSCEVNGPILTTYS

SEQ ID NO: 1056 - protein, 119 aa, Neisseria
  VARIANT (1)...(119): Xaa = Any Amino Acid
MSVILPPTRANAAFSAWARLMILSCLLCWCAACPWSSSPCPSWWASAGAEMPISAVAAAVKRRRLKFIFAPAKYLXXCLKDVKAGHQPAVNTARTIPRAASASAARSCEANGPILTTYS

SEQ ID NO: 1057 - protein, 116 aa, Neisseria
MQFRRHRRRQCPNRKPIMTASMYILLVLALIFANAPFLTTRLFGVAALKRKHFGHHLIELAAGFALTASLAYILESRAGAVHNQGWEFYATVVCLYLIFAFPCFVRRYFWHTRNRE

SEQ ID NO: 1058 - protein, 120 aa, Neisseria
  VARIANT (1)...(120): Xaa = Any Amino Acid
MPFRNAFRRHRRRQRLNRKPTMTASMYILLVLALIFANAPFLTTRLFGVAXLKRKHFGHHMIELAAGFALTAVLAYILESRAGSVHDQGWEFYATVVCLYLIFAFPCFVWRYFWHTRNRE

SEQ ID NO: 1059 - protein, 120 aa, Neisseria
MPFRNAFRRHRRRQCPNRKPAMTASMYILLLLALIFANAPFLTTKLFGIVPLKRKHFGHHLIELAAGFALTAVLAYILESRAGAVHDQGWEFYATVVCLYLIFAFPCFVWRYFWHTRNRE

SEQ ID NO: 1060 - protein, 127 aa, Neisseria
MQVAFFLAVVFKNMGFHNRIGRAGLFAETAEDALGQVDVVTLGAAGAVFAFFRFDVDRHCRTHRLAQFTRDAAFLSVRKTALRVQTAETHGLRRFLFGKINCVFAGKKVFERYAHAFDQFAKQKGFY

SEQ ID NO: 1061 - protein, 127 aa, Neisseria
VQVAFFLAVVFKNMGFHNRISRACLFAETAEDALGQVDVVTLGAARTVFTFFRFDVNRHCRTHCLTQLTRDTPLFAVRIPPLRVQTAETHGLRRFLFGEINCVFAGEKVFERYAHTFYQFAKQKGFY

SEQ ID NO: 1062 - protein, 127 aa, Neisseria
VQVAFFLAVVFKNMGFHNRIGRAGFFAETAEDALGQVDVVTLGAARAVFAFFRFDVDRHCGANGFTQFTRDAAFLAVWITALRVQTAETHGLRRFLFGKINRVFAGKKVFERYAHTFYQFAKQKGFY

SEQ ID NO: 1063 - protein, 337 aa, Neisseria
MKKNLPALALASMLILSGCDRLGIGNPFSGKEISCGSEETKEILVKLVRDNVEGETVKTFDDDAFKDQAFADIGISHIRRMVERLGITVDEVRTTEKTDTSSKLKCEAALKLDVPDDVVDYAVAANQSIGNSHKKTPDFFEPYYRKEGAYYVKTISYSVQPTDDKSKIFAELSQAHDIIHPLSELVSMALIKEPLDKAKQRNEKLEAAEATAQEAREAEEAAAQEALGREQEAARVSEWEERYKLSRSEFEQFWKGLPQTVQNKLQASQKTWKSGMDKICANNAKAEGETPNGIKVSELACKTAETEARLEELHNRKKALIDEMVREEDKKELPKRL

SEQ ID NO: 1064 - protein, 140 aa, Neisseria
  VARIANT (1)...(140): Xaa = Any Amino Acid
MALIKEPLDKVKQRNEELEAAEEAAAQEALGREQEAARVSEWEERYKLSRXQFEQFWKGLPQTVQNKLQPSQKTWKSGMDKICANNAKAEGKTPNGIKFSELACKTAKTEARLEELHNRKKALIDEMXREADXKELSKRL

SEQ ID NO: 1065 - protein, 140 aa, Neisseria
MALIKEPLDKAKQRNEELEAAEEAAAQEALGREQEVDRVSEWEERYKLSRSEFEQFWKGLPQTVQNKLQASQKTWKSGMDKICANNAKAEGETPNGIKFSELACKTAETEARLEELHNRKKALLDEMAREADKKELPKRL

SEQ ID NO: 1066 - protein, 158 aa, Neisseria
VQSRYDGLHKFKHICSAAMALIKEPLDKVKQRNEELEAAEEAAAQEALGREQEAARVSEWEERYKLSRSEFEQFWKGLPQTVQNKLQASQKTWKSGMDKICANNAKAEGKTPNGIKFSELACKTAKTEARLEELHNRKKALIDEMAREADKKELSKRL

SEQ ID NO: 1067 - protein, 158 aa, Neisseria
VQSRYDGLHKFKHICSAAMALIKEPLDKAKQRNEELEAAEEAAAQEALGREQEVDRVSEWEERYKLSRSEFEQFWKGLPQTVQNKLQASQKTWKSGMDKICANNAKAEGETPNGIKFSELACKTAETEARLEELHNRKKALLDEMAREADKKELPKRL

SEQ ID NO: 1068 - protein, 121 aa, Neisseria
MVWRVNCAATAALIFSSSPWIWAVVWVWSRSAFSCKPCASLDASSAPALAVSPWDFIRNTASPKVSAALMHSFKTRALGRFSAPPVAILLSNRGVKKPLSFKSPSVQVDTSALLCLSLRSS

SEQ ID NO: 1069 - protein, 120 aa, Neisseria
MVWRVNCAATAVLIFSSSPWIWAAVWVWSRSALSCKPCATCPRPAPALMVSPWDFIQNTASPKVSAALMHSFKTRALGRFSSPPVAILLSERGVKKPLSFKFSSVQVDTSALLCLSLRSS

SEQ ID NO: 1070 - protein, 121 aa, Neisseria
MVWRVNCAATAVLIFSSSPWIWAAVWVWARSALSWRFCASVPASSAPALTVSPWDFIQNTASPKVSAALMHSFKTRALGRFSSPPVAILLSGRGVKKPLSFKFSSVQVDTSALLCLSLWSS

SEQ ID NO: 1071 - protein, 140 aa, Neisseria
MNKNRKLLLAALLLTAFAAFKLVLLQWWQAQQPQAVAAQCDLTEGCTLPDGSRVRAAAVSTKKPFDIYIEHAPAGTEQVSISFSMKNMDMGFNRYMFERQPSGTWQAARIRLPVCVEGRRDFTADITIGSRTFQTAFTAE

SEQ ID NO: 1072 - protein, 140 aa, Neisseria
  VARIANT (1)...(140): Xaa = Any Amino Acid
MNKNRKLLLAALLLIAFAAVKLVLLQWWQAXQPQAVAAQCDLTEGCTLPDGSRVRAAAVSTKKPFDIYIEHAPAGTEQVSISFSMKNMDMGFNRYMFERQPSGTWQAVRIRLPICVEGRRDFTADITIGSRTFQTAFTAE

SEQ ID NO: 1073 - protein, 140 aa, Neisseria
MNKNRKLLLAALLLIAFAAVKLVLLQWWQAQQPQAVAAQCDLTEGCTLPDGSRVRAAAVSTKKPFDIYIEHAPAGTEQVSISFSMKNMDMGFNRYMFERQPSGTWQAVRIRLPICVEGRRDFTADITIGSRTFQTAFTAE

SEQ ID NO: 1074 - protein, 190 aa, Neisseria
MFSSRMARIWATGVTLCMVSPCPALTTKPKSPAKCAPFWMRSNCLICSAWLCASAYAPVCSSTTGAPTSRAAWICLSSASINKDTRMPASVRILANSAIFSCCANTSKPPSVVISCRFSGTMHTSSGITLSAFSSISSVNAISRFRRVRMAFLTANTSASLMWRRSSRRCMVIRSAPCVSATSAASTGLG

SEQ ID NO: 1075 - protein, 190 aa, Neisseria
  VARIANT (1)...(190): Xaa = Any Amino Acid
XFSSRMARIWAMGVTLCMVSPCPALTTKPKSPAKCAPFWMRSNCLICSAWLRASAYAPVCSSTTGAPTSRAAWICLSSASINKDTRMPASVRILVNPAIFSCCANTSKPPSVVISXRFSGTMHTSSGITFKAFSNISSVNAISRFRRVRMAFLTANTSASLMWRRSSRRCMVIKSAPCVSATSAASTGLG

SEQ ID NO: 1076 - protein, 189 aa, Neisseria
MFSSRMARIWAMGVTLCMVSPCPALTTKPKSLAKCAPFWMRSNCLICSAWLRASAYAPVCSSTTGAPTSRAAWICLSSASINKDTRMPASVRILVNSAILSCCANTSKPPSVVISRFSGTMHTSSGITLSAFSSISSVNAISRFRRVRMAFLTANTSASLMWRRSSRRCMVIRSAPCVSATSAASTGLG

SEQ ID NO: 1077 - protein, 370 aa, Neisseria
MTAKEELFAWLRHMNKNKGSDLFVTTHFPPAMKLDGKITRITDEPLTAEKCMEIAFSIMSAKQAEEFSSTNECNFAISLPDTSRFRVNAMIQRGATALVFRAITSKIPKFESLNLPPALKDVALKKRGLVIFVGGTGSGKSTSLASLIDYRNENSFGHIITIEDPIEFVHEHKNCIITQREVGVDTENWMAALKNTLRQAPDVILIGEIRDRETMDYAIAFAETGHLCMATLHANSTNQALDRIINFFPEERREQLLTDLSLNLQAFISQRLVPRDGGKGRVAAVEVLLNSPLISELIHNGNIHEIKEVMKKSTTLGMQTFDQHLYQLYEKGEISLQDALKNADSAHDLRLAVQLRSRRAQSSDPDLELL

SEQ ID NO: 1078 - protein, 370 aa, Neisseria
  VARIANT (1)...(370): Xaa = Any Amino Acid
MTAKEELFAWLRHMXQNKGSDLFVTTHFPPAMKLDGKITRITDEPLTAEKCMEIAFSIMSAKQAEEFSSTNECNFAISLPDTSRFRVNAMIQRGATALVFRTITSKIPKFESLNLPPVLKDVALKKRGLVIFVGGTGSGKSTSLASLIDYRNENSFGHIITIEDPIEFVHEHKNCIITQREVGVDTENWMAALKNTLRQAPDVILIGEIRDRETMDYAIAFAETGHLCMATLHANSTNQALDRIINFFPEERREQLLTDLSLNLQAFISQRLVPRDGGKGRVAAVEVLLNSPLISELIHNGNIHEIKEVMKKSTTLGMQTFDQHLYQLYEKGDISLQEALKNADSAHDLRLAVQLRSRRAQSXSPDLXLL

SEQ ID NO: 1079 - protein, 370 aa, Neisseria
MTAKEELFAWLRHMNKNKGSDLFVTTHFPPAMKLDGKITRITDEPLTAEKCMEIAFSIMSAKQAEEFSSTNECNFAISLPDTSRFRVNAMIQRGATALVFRAITSKIPKFESLNLPPVLKDVALKKRGLVIFVGGTGSGKSTSLASLIDYRNENSFGHIITIEDPIEFVHEHKNCIITQREVGVDTENWMAALKNTLRQAPDVILIGEIRDRETMDYAIAFAETGHLCMATLHANSTNQALDRIINFFPEERREQLLTDLSLNLQAFISQRLVPRDGGKGRVAAVEVLLNSPLISELIHNGNIHEIKEVMKKSTTLGMQTFDQHLYQLYEKGEISLQDALKNADSAHDLRLAVQLRSRQAQSSGPDLELL

SEQ ID NO: 1080 - protein, 171 aa, Neisseria
  VARIANT (1)...(171): Xaa = Any Amino Acid
MSLQAVFIYPPSRTAQYNENQENGGKAHKQGQSGKHTDRRQDIGVFEAGTPFTVFLPFLVAFEIKDDAGKQRGSRARHWHCVHCCSLTVKNPPGRATVLRREIAKFVCGRVPLKSRRFEKCFXRARPMCRNIICRSPAKSPRTRFAEFPRCPLVSYGVCLLFVFQAVFSYA

SEQ ID NO: 1081 - protein, 169 aa, Neisseria
  VARIANT (1)...(169): Xaa = Any Amino Acid
MSLQAVFIYPPSRTAQYNENQENGGKAHKQGQSGKHADRCQDIGVFKAGTPFPVFLPLLVAFEIKDDAGKQRGSRARHHCVHCCSLMLKNPPVRATVLRRQIAKFVCGRVPLKSGRFEGCSRRAALCAGVICRSPAKSPRTRFAEFPHCPLVSYGVYLPFVXQAVFSYA

SEQ ID NO: 1082 - protein, 168 aa, Neisseria
MSLQAVFVYPPSRTAQYNENQENGGKAHKQGQSGKHADRRQDIGVFQTGTPFTVFLPLFVAFEIKDDAGKQRGSRARHHNVHCCSLTVKNPPVRATVFKRRITKFVGGRALLQSGRFKGHDALPRVPDIICRSPAKLPRTRFAGFPHCPLVSYGVCLLFVFQAVFSYA

SEQ ID NO: 1083 - protein, 163 aa, Neisseria
MAGPIFVVIASVAMFFVAQQHATDLVTDDYYKDGKHIDIQLHRDEEAVRRHIGVQVLISPDMNAAKVFVGGEFDGKQPLNLLLMHPTRKADDQTVALKPVGSAQNGRAEYEAVFKTLPPANHWYVRVEDAAGVWRVENKWITSQGNAVDLTPMDKLFNNAGSK

SEQ ID NO: 1084 - protein, 163 aa, Neisseria
MAGPIFVVIASVAMFFVAQQHATDLVTDDYYKDGKHIDIQLHRDEEAVRRHIGVQVLISPDMNAAKVFVGGEFDGKQPLNLLLMHPTRKADDQTVALKPVGSAQNGRAEYEAVFKTLSPTNHWYVRVEDAAGVWRVENKWITSQGNAVDLTPMDKLFNNTESK

SEQ ID NO: 1085 - protein, 163 aa, Neisseria; identical to SEQ ID NO: 1084

SEQ ID NO: 1086 - protein, 278 aa, Neisseria
MILPPSMTMMRSADSTVVRRWATMMPVRFSIRRSSACWTRRSDSLSNALVASSNNNIGASFKMARAMATRCRCPPDKLLPFDPMGWCSPSGDASIRLCRLAAWRADRTSASPASGRLYRTFSNRVSSNRNTSWETRANWARRQSSLMSAMSIPSMQMLPADGSTKRGRRLTTVDLPLPERPTRATRSPCLMSRLKLSRALMPSERYSTSTLRKLMRPSTRCGASVPLSCSGGVSRNAHTPSAARNIVCIGMLMLARLLMGAYICSIATMNAINSPMVV

SEQ ID NO: 1087 - protein, 278 aa, Neisseria
MILPSSITMMRSAPSMVVRRWATMMPVRFSIRRSSACWTRRSDSLSNALVASSNNNIGASFKMARAMATRCRCPPDKLLPFDPMGWCSPSGELSIRLCRLAVWRANRTSASPASGRLYRTFSNRVSSNRNTSWETRANWARRQSSLMSAMSIPSMQMLPADGSTKRGSRLTTVDLPLPERPTRATRSPCLMSRLKLSRALMPSERYSTSTLRKLMRPSTRCGASVPLSCSGGVSRNAHTPSAARNIVCIGMLMLARLLMGAYICSIATMNAINSPMVV

SEQ ID NO: 1088 - protein, 278 aa, Neisseria
MILPSSITMMRSAPSMVVRRWATMMPVRFSIRRSSACWTRRSDSLSNALVASSNNNIGASFKMARAMATRCRCPPDKLLPFDPMGWCSPSGDASIRLCRLAAWRADRTSASPASGRLYRTFSNRVSSNRNTSWETRANWARRQSSLMSAMSIPSMQMLPADGSTKRGSRLTTVDLPLPERPTRATRSPCLMSRLKPSRALMPSERYSTSTLRKLMRPSTRCGASVPLSCSGGVSRNAHTPSAARNIVCIGMLMLARLLMGAYICSIATMNAINSPMVV

SEQ ID NO: 1089 - protein, 222 aa, Neisseria
MVHVAVAYGIAVRRFCPNEVIDVFHALQVHRQAFDAVGNFAEYGRAIDTADLLEIGKLGYFHAVEPDFPAQTPRTEGGVFPVVFDKADVVDFGIDAQFAQGVEIEVLDIGGGGFEGDLELVIVLQAVGVVAVAAVFGAAAGLDVGGKPRLGAERAQAGGGMGCAGTDFHVEGLDDGAAFVCPEGLQFEDDLLEGKHGLLFDKIKVLFYCFHSRLNRFISKTA

SEQ ID NO: 1090 - protein, 252 aa, Neisseria
MPRFEDKLVGRQGEGGVFFGKQAFGLRFVVVELAQQPVGIAVFEVVGGLLDFVLVVHVAVGDGVAVERFCPNEVVDVFYTLQVHRQAFDAVGDFAEYGRAVDAADLLEIGKLGYFHAVEPDFPAQTPRAEGGVFPVVFDKADVVDFGIDAQFAQRVEIEVLDIGGSGLEGDLELVIVLQAVGVVAVAAVFGAAAGLDVGGKPRLGAECAQAGGGMGCAGTDFHVEGLDDGAAFVCPECLQFEDDLLEGKHGL

SEQ ID NO: 1091 - protein, 252 aa, Neisseria
MPRFEDKLVGRQGEGGVFFGKQAFGLRFVVVELAQQPIGIAVFEVVGGLFDFVLVVHVAVSYCITVQRFCPNEVIDVFHALQVHRQAFDAVGDFAEYGGAVDAADLLEIGELGYFHTVEPDFPAQTPRAEGGVFPVVFDKADVVHFGVDAQFAQGVEIEVLDIGGSGLEGDLELVIVLQAVGVVAVATVFGAAAGLDVGGKPRLGAECAQTGGGMGCAGTDFHVEGLDDGAAFVCPECLQFEDDLLEGKHGL

SEQ ID NO: 1092 - protein, 170 aa, Neisseria
LRAITPGAIFSTGAVKVVLIGPLPSIGRPNASTTRPTNSRPTGTSKIRPVQVTVSPSLICSYSPNTTAPTESRSRFIAKPKVLPGNSSISPCIASDKPWMRTIPSVTEITVPRVLTSAFTDRFSILALIRSLISAGLSCMKTLLIRHSRVQSTQFALYRQIQNLITHFNF

SEQ ID NO: 1093 - protein, 219 aa, Neisseria
LRAITPGAIFSIGAVKVVLIGPLPSIGRPNASTTRPTSSRPTGTSKIRPVQVTVSPSLMCSYSPNTTAPTESRSRFIAKPKVLPGNSSISPCIASDKPWMRTIPSVTEITVPQVRTSAFTDRFSILALIKSLISAGLSCMKTLLIRHSRVQGTQFALYRQIQNLITHFNFYAANQLRFDFDRDFQLAVETLIQHLHQLADLFVGQRIGTVNDGRFDMVE

SEQ ID NO: 1094 - protein, 219 aa, Neisseria
LRAITPGAIFSIGAVKVVLIGPLPSIGRPNASTTRPTSSRPTGTSKIRPVQVTVSPSLICSCSPNTTAPTESRSRFIAKPKVLPGNSSISPCIASDKPWMRTIPSVTEITVPRVRTSAFTDRFSILALIKSLISAGLSCMKTLLIRHSRVQGTQFALYRQIQNLITHFNFYAANQLRFDFDRDFQLAVETLIQHLRQLADLFVGQRIGTVNDGRFDMVE

SEQ ID NO: 1095 - protein, 152 aa, Neisseria
MTRICGCLISTVLSVSASLSAAGFIRLQWEGTDTGSGRARLAPASLAAAMVRPTAAALPAITTCPGELKLTASTTSPCADSAQICLTCSSSKPKMAAIAPTPCGTADCISSARRRTSLTASAKSNASAATSAVYSPRLCPATAAGVLPPTSK

SEQ ID NO: 1096 - protein, 152 aa, Neisseria
ITRICGCLISTVFRASASLSAAGFIRLQWEGTDTGSGRARLAPASLAAAMARPTAAALPAITICPGELKLTASTTSLWAASAQMALTCSSSKPRIAAIAPTPCGTADCISSARRRTSLTASAKFNAPAATSAVYSPRLCPATAAGVLPPASK

SEQ ID NO: 1097 - protein, 152 aa, Neisseria
  VARIANT (1)...(152): Xaa = Any Amino Acid
MTXICGCLISTVXRASASLSAAGFMRLQWEGTDTGSGRARLAPASLAASIARSTAAALPAITTCPGELKLTASTTSSCADSAQICFTCSSSKPRIAAIAPTPCGTADCISSARXRTSLTASAKSNAPAATSAVYSPXLCPATAAGVLPPASE

SEQ ID NO: 1098 - protein, 308 aa, Neisseria
MKHLKLTLIAALLATAATAAPLPVVTSFSILGDVAKQIGGERVAVQSLVGANQDTHAYHMTSGDIKKIRSAKLVLLNGLGLEAADIQRAVKQSKVSYAEATKGIQPLKAEEEGGHHHDHHHDHDHDHEGHHHDHGEYDPHVWNDPVLMSDYAQNVAETLIKADPEGKVYYQQRLGNYQMQLKKLHSDAQAAFNAVPAAKRKVLTGHDAFSYMGNRYNISFIAPQGVSSEAEPSAKQVAAIIRQIKREGIKAVFTENIKDTRMVDRIAKETGVNVSGKLYSDALGNAPADTYIGMYRHNVEALTNAMKQ

SEQ ID NO: 1099 - protein, 304 aa, Neisseria
MKHLKLTLIAALLTASATAAPLPVVTSFSILGDVAKQIGGERVSIQSLVGANQDTHAYHMTSGDIKKIRSAKLVLLNGLGLEAADVQRAVKQSKVSYTEATKGIQPLKAEEEGGHHHDHDHDHEGHHHDHGEYDPHVWNDPVLMSAYAQNVAKALIKADPEGKVYYQQRLGNYQMQLKKLHSDAQAAFNAVPAAKRKVLTGHDAFSYMGKRYHIEFIAPQGVSSEAEPSAKQVAAIIRQIKREGIKAVFTENIKDTRMVDRIAKETGVNVSGKLYSDALGNAPADTYIGMYRHNIKALTNAMKQ

SEQ ID NO: 1100 - protein, 308 aa, Neisseria
MKHPKLTLIAALLTTAATAAPLPVVTSFSILGDVAKQIGGERVSIQSLVGANQDTHAYHMTSGDIKKIRSAKLVLINGLGLEAADIQRAVKQSKVSYAEATKGIQPLKAEEEGGHHHDHDHDHDHDHEGHHHDHGEYDPHVWNDPVLMSAYAQNVAEALIKADPEGKVYYQQRLGNYQMQLKKLHSDAQAAFNAVPAAKRKVLTGHDAFSYMGKRYHIEFIAPQGVSSEAEPSAKQVAAIIRQIKREGIKAVFTENIKDTRMVDRIAKETGVNVSGKLYSDALGNAPADTYIGMYRHNIKALTNAMKQ

SEQ ID NO: 1101 - protein, 275 aa, Neisseria
MHYALASVFCLSLSAAPVGVFLVMRRMSLIGDALSHAVLPGAAVGYMFAGLSLPAMGVGGFAAGMLMALLAGLVSRFTTLKEDANFAAFYLSSLAIGVILISKNGSSVDLLHLLFGSVLAVDIPALQLIAAVSGLTLITLAVIYRPLVLESIDPLFLKSVNGKGGLWHVIFLILVVMNLVSGFQALGILMSVGIMMLPAITARLWARNMGTLILLSVLIALFCGLIGLLISYHIEIPSGPAIILCCSVLYLFSVILGKEGGILPKWFKNHRHHTT

SEQ ID NO: 1102 - protein, 264 aa, Neisseria
MRYALASVFCLSLSAAPVGVFLVMRRMSLIGDALSHAVLPGAAVGYMFAGLSLPAMGLGGVAAGMLMALLAGLVSRFTTLKEDANFAAFYLSSLAIGVVLVSKNGSSVDLLHLLFGSVLAVDIPALQLIAAVSSLTLITLAVIYRPLVLESIDPLFLKSVGGKGGLWHVLFLVLVVMNLVSGFQALGTLMSVGLMMLPAITARLWAKHMGALILLSVLTALLCGLSGLLISYHIEIPSGPAIILCCSVLYLFSVILGKEGGILT

SEQ ID NO: 1103 - protein, 275 aa, Neisseria
MRYALASVFCLSLSAAPVGVFLVMRRMSLIGDALSHAVLPGAAVGYMFAGLSLPAMGLGGVAAGMLMALLAGLVSRFTTLKEDANFAAFYLSSLAIGVVLVSKNGSSVDLLHLLFGSVLAVDIPALQLIAAVSTLTLLTLAVIYRPLVLESIDPLFLKSVGGKGGLWHVLFLVLVVMNLVSGFQALGTLMSVGLMMLPAITARLWAKHMGALILLSVLTALLCGLSGLLISYHIEIPSGPAIILCCSVLYLFSVILGKEGGILTKWLKNHRHHTT

SEQ ID NO: 1104 - protein, 217 aa, Neisseria
MGLGMEIGKLIVALLVLINPFSALSLYLDLTNGHSTKERRKVARTAAVAVFAVIAVFALIGGALLKVLGISVGSFQVGGGILVLLIAISMMNGNDNPAKQNLGAQPETGQARPARNAGAIAVVPIAIPITIGPGGISTVIIYASAAKTYSDIALIIAAGLVVSAICYAILIVAGKVSRLLGATGLTILNRIMGMMLAAVSVEIIVSGLKTIFPQLAG

SEQ ID NO: 1105 - protein, 217 aa, Neisseria
MGLGMEIGKLIVAFLVLINPFSALSLYLDLTNGHSTKERRKVARTAAVAVFAVIAVFALIGGTLLKVLGISVGSFQVGGGILVLLIAISMMNGNDNPAKQNLGAQPETGQARPARNAGAIAVVPIAIPITIGPGGISTVIIYASAAKTYGDIALIIAAGLVVSAICYAILIVAGKVSRLLGATGLTILNRIMGMMLAAVSVEIIVSGLKTIFPQLAG

SEQ ID NO: 1106 - protein, 217 aa, Neisseria
MGLGMEIGKLIVAFLVLINPFSALSLYLDLTNGHSTKERRKVARTAAVAVFAVIAVFALIGGTLLKVLGISVGSFQVGGGILVLLIAISMMNGNDNPAKQNLGAQPETGQVRPARNAGAIAVVPIAIPITIGPGGISTVIIYASAAKTYGDIALIIAAGLVVSAICYAILIVAGKVSRLLGATGLTILNRIMGMMLAAVSVEIIVSGLKMIFPQLAG

SEQ ID NO: 1107 - protein, 142 aa, Neisseria
MNFALSVITFTLASFLPVPPAGTAVFTWKDGGGNSYSDVPKQLHPDQSQILNLRTLQTKPAVKPKPAVDTNADSAKENEKDIAEKNGQLEEEKKKIAETERQNKEENCRISKMNLKAVGNSNAKNKDDLIRKYNNAVNKYCR

SEQ ID NO: 1108 - protein, 144 aa, Neisseria
MNFALSVIMLTLASFLPVPPAGAAVFTWKDGGGNSYSDVPKQLHPDQSQILNLRTRQTKPAVKPAQADAGKRTDGAAQENNPDTAEKNRQLEEEKKRIAETERQNKEENCRISKMNLKAVGNSNAKNKDDLIRKYNNAVNKYCR

SEQ ID NO: 1109 - protein, 144 aa, Neisseria; identical to SEQ ID NO: 1108

SEQ ID NO: 1110 - protein, 298 aa, Neisseria
MPSETRNRFQTALVYAAGWGLAVFVTAFAFACKRVAGFAFAFEAFAGFFETVFLKAFFLETFAARFAAEAFFARFMIAAPAAGFPIAPAAFAFRLAACGFAFAGRLHAFDGQFGQFAVNVFFDFVDFDVFVHFGKRNRNTRAACAAGAPDAVDVVFRLFRQVVVYDVGNGRYVNTACGNVGGNQNFAAAFTQIRQRAVAPALRHIAVQAVGGETFFVQFIRDDFGHRFGGRENHTLVDVGIAQDVVEQAVFVAHIVAVQQLLFDFALAVHAFDFDNFRVFGQFARQFADCAVPSGGEQ

SEQ ID NO: 1111 - protein, 424 aa, Neisseria
MPSETRNRFQTALVYAAGWGLAVFVTAFAFACKRIAGFAFAFEAFAGFFETVSLKAFFLETFAARFAAEAFFARFMIAAPTAGFTIAPAAFAFRLAACGFAFAGRFHAFDGQFGQFSVNVFFDFVDFDVFVHFGKRNRNTRAACAAGAPDAVDVVFRLFRQVVVDNVGNGRYVDTACGNIGGNQNFAAAFTQIHQRAVAPALRHIAVQAVCGETFFVQFIRNDFGHGFGGRENHALIDIGIAQDMIEQAVFVAHIVAVQQLFFDFALIVHAFDFDDFRVFGQFARQFADRAVPSGGEQQSLTVARRCFHDGFDVVDKAHIQHTVGFVQNQHFQTFKINFAALHQVHQTARRGDNQIDRFAQGTGLVAERRAADDADGAEPTHIFGIRQRVFLDLSRQFAGRGQHQSTRAFARFFAAFGQFLQSR

SEQ ID NO: 1112 - protein, 424 aa, Neisseria
MPSETRNRFQTALVYAAGWGLAVFVTAFAFACKRIAGFAFAFEAFAGFFETVSLKAFFLETFAARFAAEAFFARFMIAAPTAGFTIAPAAFAFRLAACGFAFAGRFHAFDGQFGQFSVNVFFDFVDFDVFVHFGKRNRNTRAACAAGAPDAVDVVFRLFRQVVVDNVGNGRYVDTACGNVGGNQNFAAAFAQIHQRAVAPALRHIAVQAVGGETFFVQFIRDDFGHGFGGRENHALIDVGIAQDMIEQAVFVAHIVAVQQLFFDFALVVHAFDFDDFRVFGQFARQFADRAVPSGGEQQSLTVFRRGFDDGFDVVDKAHIQHTVGFVQNQHFQAGEIDFAALHQVHQTARRGDNQIDRFAQGAGLVAERCTTDDADGTEPTHIFGIRQRVFLDLSRQFAGRRQHQRARAFARFFAAFGQSLQSR

SEQ ID NO: 1113 - protein, 1389 aa, Neisseria
MTDTTPTDTDPTENGTRKMPSEHRPAPPAKKRRPLLKLSAALLSVLILAVCFLGWIAGTEAGLRFGLYQIPSWFGVNISSQNLKGTLLDGFDGDNWSIETEGADLKISRFRFAWKPSELMRRSLHITDISAGDIAIVTKPTPPKEERPPQGLPDSIDLPAAVYLDRFETGKISMGKTFDKQTVYLERLNAAYRYDRKGHRLDLKAADTPWSSSSGSASVGLKKPFALDTAIYTKGGFEGETIHSTARLSGSLKDVRAELTIDGGNIRLSGKSVIHPFAESLDKTLEEVLVKGFNINPSAFVPSLPDAGLNFDLTAIPSFSDGIALEGSLDLENTKAGFADRNGIPVRQVLGGFVIRQDGTVHIGNTSAALLGRGGIRLSGKIDTEKDILDLNIGINSVGAEDVLQTAFKGRLDGSIGIGGTTASPKISWQLGTGTARTDGSLPIASDPANEQRKLVFDTVNISAGEGSLTAQGYLELFKDRLLKLDIRSRAFDPSRIDPQFPAGNINGSIHLAGELAKEKFTGKMRFLPGTFNGVPIAGSADIVYESRHLPRAAVDLRLGRNIVKTDGGFGKKGDRLNLNITAPDLSRFGFGLAGSLNVRGHLSGDLDGGIRTFETDLSGTARNLHIGKAADIRSLDFTLKGSPGTSRPMRADIKGGRLSLSGGAAVVDTAGLTLEGTGAQHRIRTHAAMTLDGKPFKLDLDASGGINRELTRWKGSIGILDIGGAFNLKLQNRMTLEAGAEHVAASAANWQAMGGSLNLQHFSWDRKTGISAKGGARGLHIAELHNFFKPPFEHNLVLNGDWDVAYGHNARGYLNISRQSGDAVLPGGQALGLNAFSLKTRFQNDRIGILLDGGARFGRINADLGIGNAFGGNMANTPLGGRITASLPDLGALKPFLPAAAQNITGSLNASAQIGGRVGSPSVNAAVNGSSNYGKINGNITVGQSRSFDTAPLGGRLNLTVADAEAFRNFLPVGQTVKGSLNAAVTLGGSIADPHLGGSINGDKLYYRNQTQGIILDNGSLRSHIAGRKWVIDSLKFRHEGTAELSGTVSMENSVPDVDIGAVFDKYRILSRPNRRLTVSGNTRLRYSPQKGISVTGMIKTDQGLFGSQKSSMPSVGDDVVVLGEVKKEAAASLPVNMNLTLDLNDGIRFSGYGADVTIGGKLTLTAQPGGNVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYGISSAEQSVKLIYRLTRAIQAVARIGSRSSGGELTYTIRFDRLFGSDKKDSAGNGKGK

SEQ ID NO: 1114 - protein, 1389 aa, Neisseria
MTDTAPTDTDPTENGTRKMPSEHRPTPPAKKRRPLLKLSAALLSVLILAVCFLGWLAGTEAGLRFGLYQIPSWFGVNISSQNLKGTLLDGFDGDNWSIETEGADLKISRFRFAWKPSELMRRSLHITEISAGDIAIVTKPTPPKEERPPLSLPDSIDLPAAVYLDRFETGKISMGKAFDKQTVYLERLDASYRYDRKGHRLDLKAADTPWSSSSGAASVGLKKPFALDTAIYTKGGLEGKTIHSTARLSGSLKDVRAELAIDGGNIRLSGKSVIHPFAESLDKTLEEVLVKGFNINPAAFVPSLPDAGLNFDLTAIPSFSDGIALEGSLDLENTKAGFADRNGIPVRQVLGGFVIRQDGTVHIGNTSAALLGRGGIRLSGKIDTEKDILDLNIGINSVGAEDVLQTAFKGRLDGSIGIGGTTASPKISWQLGIGTARTDGSLAIASDPANGQRKLVLDTVNIAAGQGSLTAQGYLELFKDRLLKLDIRSRAFDPSRIDPQLPAGNINGSINLAGELAKEKFTGKMRFLPGTFNGVPIAGSADIVYESRHLPRAAVDLRLGRNIIKTDGGFGKKGDRLNLNITAPDLSRFGFGLAGSLNVRGHLSGDLDGGIRTFETDLSGAARNLHIGKAADIRSLDFTLKGSPDTSRPIRADIKGSRLSLSGGAAVVDTADLMLDGTGVQHRIRTHAAMTLDGKPFKFDLDASGGINRELTRWKGSIGILDIGGAFNLKLQNRMTLEAGAERVAASAANWQAMGGSLNLQHFSWDKKTGISAKGGAHGLHIAELHNFFKPPFEHNLVLNGDWDVAYGRNARGYLNISRQSGDAVLPGGQALGLNAFSLKTRFQNDRIGILLDGGARFGRINADLGIANAFGGNMANAPLGGRITASLPDLGALKPFLPAAAQNITGSLNAAAQIGGRVGSPSVNAAVNGSSNYGKINGNITVGQSRSFDTAPLGGRLNLTVADAEVFRNFLPVGQTVKGSLNAAVTLGGSIADPHLGGSINGDKLYYRNQTQGIILDNGSLRSHIAGRKWVIDSLKFRHEGTAELSGTVGMENSGPDVDIGAVFDKYRILSRPNRRLTVSGNTRLRYSPQKGISVTGMIKTDQGLFGSQKSSMPSVGDDVVVLGEVKKEAAAPLPVNMNLTLDLNDGIRFAGYGADVTIGGKLTLTAQSGGSVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYSISSAEQSVKLIYRLTRAIQAVARIGSRSSGGELTYTIRFDRFSGSDKKDSAGNGKGK

SEQ ID NO: 1115 - protein, 1389 aa, Neisseria
MTDTAPTDTDPTENGTRKMPSEHRPTPPAKKRRPLLKLSAALLSVLILAVCFLGWLAGTEAGLRFGLYQIPSWFGVNISSQNLKGTLLDGFDGDNWSIETEGADLKISRFRFAWKPSELMRRSLHITEISAGDIAIVTKPTPPKEERPPLSLPDSIDLPAAVYLDRFETGKISMGKAFDKQTVYLERLDASYRYDRKGHRLDLKAADTPWSSSSGSASVGLKKPFALDTAIYTKGGLEGKTIHSTARLSGSLKDVRAELAIDGGNIRLSGKSVIHPFAESLDKTLEEVLVKGFNINPSAFVPSLPDAGLNFDLTAIPSFSDGIALEGSLDLENTKAGFADRNGIPVRQVLGSFVIRQDGTVHIGNTSVALLGRGGIRLSGKIDTEKDILDLNIGINSVGAEDVLQTAFKGRLDGSIGIGGTTASPKISWQLGIGTARTDGSLAIASDPANGQRKLVLDTVNIAAGQGSLTAQGYLELFKDRLLKLDIRSRAFDPSRIDPQLPAGNINGSINLAGELAKEKFTGKMRFLPGTFNGVPIAGSADIVYESRHLPRAAVDLRLGRNIIKTDGGFGKKGDRLNLNITAPDLSRFGFGLAGSLNVRGHLSGDLDGGIRTFETDLSGAARNLHIGKAADIRSLDFTLKGSPDTSRPIRADIKGSRLSLSGGAEVVDTADLMLDGTGVQHRIRTHAAMTLDGKPFKFDLDASGGINRELTRWKGSIGILDIGGAFNLKLQNRMTLEAGAERVAASAANWQAMGGSLNLQHFSWDKKTGISAKGGAHGLHIAELHNFFKPPFEHNLVLNGDWDVAYGRNARGYLNISRQSGDAVLPGGQALGLNAFSLKTRFQNDRIGILLDGGARFGRINADLDIGNAFGGNMANAPLGGRITASLPDLGTLKPFLPAAAQNITGSLNAAAQIGGRVGSPSVNAAVNGSSNYGKINGNITVGQSRSFDTAPLGGRLNLTVADAEVFRNFLPVGQTVKGSLNAAVTLGGSIADPHLGGSINGDKLYYRNQTQGIILDNGSLRSHIAGRKWVIDSLKFRHEGTAELSGTVGMENSGPDVDIGAVFDKYRILSRPNRRLTVSGNTRLRYSPQKGISVTGMIKTDQGLFGSQKSSMPSVGDDVVVLGEVKKEAAAPLPVNMNLTLDLNDGIRFAGYGADVTIGGKLTLTAQSGGSVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYSISSAEQSVKLIYRLTRAIQAVARIGSRSSGGELTYTIRFDRFSGSDKKDSAGNSKGK

SEQ ID NO: 1116 - protein, 1354 aa, Neisseria
LKLSAALLSVLILAVCFLGWIAGTEAGLRFGLYQIPSWFGVNISSQNLKGTLLDGFDGDNWSIETEGADLKISRFRFAWKPSELMRRSLHITDISAGDIAIVTKPTPPKEERPPQGLPDSIDLPAAVYLDRFETGKISMGKTFDKQTVYLERLNAAYRYDRKGHRLDLKAADTPWSSSSGSASVGLKKPFALDTAIYTKGGFEGETIHSTARLSGSLKDVRAELTIDGGNIRLSGKSVIHPFAESLDKTLEEVLVKGFNINPSAFVPSLPDAGLNFDLTAIPSFSDGIALEGSLDLENTKAGFADRNGIPVRQVLGGFVIRQDGTVHIGNTSAALLGRGGIRLSGKIDTEKDILDLNIGINSVGAEDVLQTAFKGRLDGSIGIGGTTASPKISWQLGTGTARTDGSLAIASDPANEQRKLVFDTVNISAGEGSLTAQGYLELFKDRLLKLDIRSRAFDPSRIDPQFPAGDINGSIHLAGELAKEKFTGKMRFLPGTFNGVPIAGSADIVYESRHLPRAAVDLRLGRNIVKTDGGFGKKGDRLNLNITAPDLSRFGFGLAGSLNVRGHLSGDLDGGIRTFETDLSGTARNLHIGKAADIRSLDFTLKGSPGTSRPMRADIKGGRLSLSGGAAVVDTAGLTLEGTGAQHRIRTHAAMTLDGKPFKLDLDASGGINRELTRWKGSIGILDIGGAFNLKLQNRMTLEAGAEHVAASAANWQAMGGSLNLQHFSWDRKTGISAKGGARGLHIAELHNFFKPPFEHNLVLNGDWDVAYGHNARGYLNISRQSGDAVLPGGQALGLNAFSLKTRFQNDRIGILLDGGARFGRINADLGIGNAFGGNMANTPLGGRITASLPDLGALKPFLPAAAQNITGSLNASAQIGGRVGSPSVNAAVNGSSNYGKINGNITVGQSRSFDTAPLGGRLNLTVADAEAFRNFLPVGQTVKGSLNAAVTLGGSIADPHLGGSINGDKLYYRNQTQGIILDNGSLRSHIAGRKWVIDSLKFRHEGTAELSGTVSMENSVPDVDIGAVFDKYRILSRPNRRLTVSGNTRLRYSPQKGISVTGMIKTDQGLFGSQKSSMPSVGDDVVVLGEVKKEAAASLPVNMNLTLDLNDGIRFSGYGADVTIGGKLTLTAQPGGNVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYGISSAEQSVKLIYRLTRAIQAVARIGSRSSGGELTYTIRFDRLFGSDKKDSAGNGKGK

SEQ ID NO: 1117 - protein, 1354 aa, Neisseria
LKLSAALLSVLILAVCFLGWLAGTEAGLRFGLYQIPSWFGVNISSQNLKGTLLDGFDGDNWSIETEGADLKISRFRFAWKPSELMRRSLHITEISAGDIAIVTKPTPPKEERPPLSLPDSIDLPAAVYLDRFETGKISMGKAFDKQTVYLERLDASYRYDRKGHRLDLKAADTPWSSSSGAASVGLKKPFALDTAIYTKGGLEGKTIHSTARLSGSLKDVRAELAIDGGNIRLSGKSVIHPFAESLDKTLEEVLVKGFNINPAAFVPSLPDAGLNFDLTAIPSFSDGIALEGSLDLENTKAGFADRNGIPVRQVLGGFVIRQDGTVHIGNTSAALLGRGGIRLSGKIDTEKDILDLNIGINSVGAEDVLQTAFKGRLDGSIGIGGTTASPKISWQLGIGTARTDGSLAIASDPANGQRKLVLDTVNIAAGQGSLTAQGYLELFKDRLLKLDIRSRAFDPSRIDPQLPAGNINGSINLAGELAKEKFTGKMRFLPGTFNGVPIAGSADIVYESRHLPRAAVDLRLGRNIIKTDGGFGKKGDRLNLNITAPDLSRFGFGLAGSLNVRGHLSGDLDGGIRTFETDLSGAARNLHIGKAADIRSLDFTLKGSPDTSRPIRADIKGSRLSLSGGAAVVDTADLMLDGTGVQHRIRTHAAMTLDGKPFKFDLDASGGINRELTRWKGSIGILDIGGAFNLKLQNRMTLEAGAERVAASAANWQAMGGSLNLQHFSWDKKTGISAKGGAHGLHIAELHNFFKPPFEHNLVLNGDWDVAYGRNARGYLNISRQSGDAVLPGGQALGLNAFSLKTRFQNDRIGILLDGGARFGRINADLGIANAFGGNMANAPLGGRITASLPDLGALKPFLPAAAQNITGSLNAAAQIGGRVGSPSVNAAVNGSSNYGKINGNITVGQSRSFDTAPLGGRLNLTVADAEVFRNFLPVGQTVKGSLNAAVTLGGSIADPHLGGSINGDKLYYRNQTQGIILDNGSLRSHIAGRKWVIDSLKFRHEGTAELSGTVGMENSGPDVDIGAVFDKYRILSRPNRRLTVSGNTRLRYSPQKGISVTGMIKTDQGLFGSQKSSMPSVGDDVVVLGEVKKEAAAPLPVNMNLTLDLNDGIRFAGYGADVTIGGKLTLTAQSGGSVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYSISSAEQSVKLIYRLTRAIQAVARIGSRSSGGELTYTIRFDRFSGSDKKDSAGNGKGK

SEQ ID NO: 1118 - protein, 1354 aa, Neisseria
LKLSAALLSVLILAVCFLGWLAGTEAGLRFGLYQIPSWFGVNISSQNLKGTLLDGFDGDNWSIETEGADLKISRFRFAWKPSELMRRSLHITEISAGDIAIVTKPTPPKEERPPLSLPDSIDLPAAVYLDRFETGKISMGKAFDKQTVYLERLDASYRYDRKGHRLDLKAADTPWSSSSGSASVGLKKPFALDTAIYTKGGLEGKTIHSTARLSGSLKDVRAELAIDGGNIRLSGKSVIHPFAESLDKTLEEVLVKGFNINPSAFVPSLPDAGLNFDLTAIPSFSDGIALEGSLDLENTKAGFADRNGIPVRQVLGSFVIRQDGTVHIGNTSVALLGRGGIRLSGKIDTEKDILDLNIGINSVGAEDVLQTAFKGRLDGSIGIGGTTASPKISWQLGIGTARTDGSLAIASDPANGQRKLVLDTVNIAAGQGSLTAQGYLELFKDRLLKLDIRSRAFDPSRIDPQLPAGNINGSINLAGELAKEKFTGKMRFLPGTFNGVPIAGSADIVYESRHLPRAAVDLRLGRNIIKTDGGFGKKGDRLNLNITAPDLSRFGFGLAGSLNVRGHLSGDLDGGIRTFETDLSGAARNLHIGKAADIRSLDFTLKGSPDTSRPIRADIKGSRLSLSGGAEVVDTADLMLDGTGVQHRIRTHAAMTLDGKPFKFDLDASGGINRELTRWKGSIGILDIGGAFNLKLQNRMTLEAGAERVAASAANWQAMGGSLNLQHFSWDKKTGISAKGGAHGLHIAELHNFFKPPFEHNLVLNGDWDVAYGRNARGYLNISRQSGDAVLPGGQALGLNAFSLKTRFQNDRIGILLDGGARFGRINADLDIGNAFGGNMANAPLGGRITASLPDLGTLKPFLPAAAQNITGSLNAAAQIGGRVGSPSVNAAVNGSSNYGKINGNITVGQSRSFDTAPLGGRLNLTVADAEVFRNFLPVGQTVKGSLNAAVTLGGSIADPHLGGSINGDKLYYRNQTQGIILDNGSLRSHIAGRKWVIDSLKFRHEGTAELSGTVGMENSGPDVDIGAVFDKYRILSRPNRRLTVSGNTRLRYSPQKGISVTGMIKTDQGLFGSQKSSMPSVGDDVVVLGEVKKEAAAPLPVNMNLTLDLNDGIRFAGYGADVTIGGKLTLTAQSGGSVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYSISSAEQSVKLIYRLTRAIQAVARIGSRSSGGELTYTIRFDRFSGSDKKDSAGNSKGK

SEQ ID NO: 1119 - protein, 522 aa, Neisseria
MQNTGTMMIKPTALLLPALFFFPHAYAPAADLSENKAAGFALFKSKSPDTESVKLKPKFPVRIDTQDSEIKDMVEEHLPLITQQQEEVLDKEQTGFLAEEAPDNVKTMLRSKGYFSSKVSLTEKDGAYTVHITPGPRTKIANVGVAILGDILSDGNLAEYYRNALENWQQPVGSDFDQDSWENSKTSVLGAVTRKGYPLAKLGNTRAAVNPDTATADLNVVVDSGRPIAFGDFEITGTQRYPEQTVSGLARFQPGTPYDLDLLLDFQQALEQNGHYSGASVQADFDRLPRGPRPRQSQRNRGQTPQTRNRHPPRFGIRFGRQNRLRLLQPLQQRLYRLGRLGYGQIRNHACRRHQPAAQLSGQLLDKQRFLQPFDHPKPRKTRLLRRHLVCARPRGHRCQAGGGISRRRPENPRLGCRFGQQPRHDADRLLETPAAQQRAAPRKRPLPRRQNRDDFGHIPVLHRANPHLCPRRLFLHARKQKTRHVHHTRTSGLHRCTRQCRCPLGADVPQRRRVFRARLRT

SEQ ID NO: 1120 - protein, 615 aa, Neisseria
MHDTRTMMIKPTALLLPALFFFPHAYAPAADLSENKAAGFALFKNKSPDTESVKLKPKFPVLIDTQDSEIKDMVEEHLPLITQQQEEVLDKEQTGFLAEEAPDNVKTMLRSKGYFSSKVSLTEKDGAYTVHITPGPRTKIANVGVAILGDILSDGNLAEYYRNALENWQQPVGSDFDQDSWENSKTSVLGAVTRKAYPLAKLGNTQAAVNPDTATADLNVVVDSGRPIAFGDFEITGTQRYPEQIVSGLARFQPGMPYDLDLLLDFQQALEQNGHYSGASVQADFDRLQGDRVPVKVSVTEVKRHKLETGIRLDSEYGLGGKIAYDYYNLFNKGYIGSVVWDMDKYETTLAAGISQPRNYRGNYWTSNVSYNRSTTQNLEKRAFSGGVWYVRDRAGIDARLGAEFLAEGRKIPGSAVDLGNSHATMLTASWKRQLLNNVLHPENGHYLDGKIGTTLGTFLSSTALIRTSARAGYFFTPENKKLGTFIIRGQAGYTVARDNADVPSGLMFRSGGASSVRGYELDSIGLAGPNGSVLPERALLVGSLEYQLPFTRTLSGAVFHDMGDAAANFKRMKLKHGSGLGVRWFSPLAPFSFDIAYGHSDKKIRWHISLGTRF

SEQ ID NO: 1121 - protein, 615 aa, Neisseria
MHDTRTMMIKPTALLLPALFFFPHAYAPAADLSENKAAGFALFKNKSPDTESVKLKPKFPVRIDTQDSEIKDMVEEHLPLITQQQEEVLDKEQTGFLAEEAPDNVKTMLRSKGYFSSKVSLTEKDGAYTVHITPGPRTKIANVGVAILGDILSDGNLAEYYRNALENWQQPVGSDFDQDSWENSKTSVLGAVTRKAYPLAKLGNTRAAVNPDTATADLNVVVDSGRPIAFGDFEITGTQRYPEQIVSGLARFQPGTPYDLDLLLDFQQALEQNGHYSGASVQADFDRLQGDRVPVKVSVTEVKRHKLETGIRLDSEYGLGGKIAYDYYNLFNKGYIGSVVWDMDKYETTLAAGISQPRNYRGNYWTSNVSYNRSTTQNLEKRAFSGGIWYVRDRAGIDARLGAEFLAEGRKIPGSDIDLGNSHATMLTASWKRQLLNNVLHPENGHYLDGKIGTTLGAFLSSTALIRTSARAGYFFTPENKKLGTFIIRGQAGYTVARDNANVPSGLMFRSGGASSVRGYELDSIGLAGPNGSVLPERALLVGSLEYQLPFTRTLSGAVFHDMGDAAANFKRMKLKHGSGLGVRWFSPLAPFSFDIAYGHSDKKIRWHISLGTRF

SEQ ID NO: 1122 - protein, 429 aa, Neisseria
MFKRSVIAMACIFPLSACGGGGGGSPDVKSADTPSKPAAPVVAENAGEGVLPKEKKDEEAAGGAPQADTQDATAGEGSQDMAAVSAENTGNGGAATTDNPKNEDAGAQNDMPQNAAESANQTGNNQPAGSSDSAPASNPAPANGGSDFGRTNVGNSVVIDGPSQNITLTHCKGDSCNGDNLLDEEAPSKSEFEKLSDEEKIKRYKKDEQRENFVGLVADRVKKDGTNKYIIFYTDKPPTRSARSRRSLPAEIPLIPVNQADTLIVDGEAVSLTGHSGNIFAPEGNYRYLTYGAEKLPGGSYALRVQGEPAKGEMLVGTAVYNGEVLHFHMENGRPYPSGGRFAAKVDFGSKSVDGIIDSGDDLHMGTQKFKAAIDGNGFKGTWTENGGGDVSGRFYGPAGEEVAGKYSYRPTDAEKGGFGVFAGKKDRD

SEQ ID NO: 1123 - protein, 488 aa, Neisseria
MFKRSVIAMACIFALSACGGGGGGSPDVKSADTLSKPAAPVVSEKETEAKEDAPQAGSQGQGAPSAQGSQDMAAVSEENTGNGGAVTADNPKNEDEVAQNDMPQNAAGTDSSTPNHTPDPNMLAGNMENQATDAGESSQPANQPDMANAADGMQGDDPSAGGQNAGNTAAQGANQAGNNQAAGSSDPIPASNPAPANGGSNFGRVDLANGVLIDGPSQNITLTHCKGDSCSGNNFLDEEVQLKSEFEKLSDADKISNYKKDGKNDKFVGLVADSVQMKGINQYIIFYKPKPTSFARFRRSARSRRSLPAEMPLIPVNQADTLIVDGEAVSLTGHSGNIFAPEGNYRYLTYGAEKLPGGSYALRVQGEPAKGEMLAGAAVYNGEVLHFHTENGRPYPTRGRFAAKVDFGSKSVDGIIDSGDDLHMGTQKFKAAIDGNGFKGTWTENGSGDVSGKFYGPAGEEVAGKYSYRPTDAEKGGFGVFAGKKEQD

SEQ ID NO: 1124 - protein, 497 aa, Neisseria
MFKRSVIAMACIVALSACGGGGGGSPDVKSADTLSKPAAPVVTEDVGEEVLPKEKKDEEAVSGAPQADTQDATAGKGGQDMAAVSAENTGNGGAATTDNPENKDEGPQNDMPQNAADTDSSTPNHTPAPNMPTRDMGNQAPDAGESAQPANQPDMANAADGMQGDDPSAGENAGNTADQAANQAENNQVGGSQNPASSTNPNATNGGSDFGRINVANGIKLDSGSENVTLTHCKDKVCDRDFLDEEAPPKSEFEKLSDEEKINKYKKDEQRENFVGLVADRVEKNGTNKYVIIYKDKSASSSSARFRRSARSRRSLPAEMPLIPVNQADTLIVDGEAVSLTGHSGNIFAPEGNYRYLTYGAEKLSGGSYALSVQGEPAKGEMLAGTAVYNGEVLHFHMENGRPSPSGGRFAAKVDFGSKSVDGIIDSGDDLHMGTQKFKAVIDGNGFKGTWTENGGGDVSGRFYGPAGEEVAGKYSYRPTDAEKGGFGVFAGKKEQD

SEQ ID NO: 1125 - protein, 182 aa, Neisseria
MHTGQAVSRVLSRTVIPLGIPLPVCSSNLPERSAGSVIAFCLVLLRMGFGLPHIVTKCAVRPYRTFSPLPVLPKQPSAVLLSVPLSVALPRPAVNRHSTLRSPDFPPRMPYAIRGDCLPVPCAARIITRNAKMPSETVQVSDGIQPKLHTLFQAGFDEAVQVAVQYGFVVADFVACTQVFDA

SEQ ID NO: 1126 - protein, 182 aa, Neisseria
MHTGQAVSRVLSRTVIPLGIPLPVCSSNLPERSAGSVIAFCLVLLRMGFGLPHIVTKCAVRPYRTFSPLPVLPKQPSAVLLSVPLSVALPRPAVNRHSTLRSPDFPPRMPYAIRGDCLPVPCAARIITRNTKMPSETVQVSDGIQPKLHALFQAGFDEAVQVAIQYGFGVADFVACTQVFDT

SEQ ID NO: 1127 - protein, 182 aa, Neisseria
MHTGQAVSRVLSRTVIPLGIPLPVCSSNLPERSAGSVIAFCLVLLRMGFGLPHIVTKCAVRPYRTFSPLPVLPKQPSAVLLSVPLSVALPRPAVNRHSTLRSPDFPPRMPYAIRGDCLPVPCAARIITRNAKMPSETVQVSDGIQPKLHALFQAGFDKAVQVAVQYGFGVADFVACAQVFNA

SEQ ID NO: 1128 - protein, 392 aa, Neisseria; identical to SEQ ID NO: 417

SEQ ID NO: 1129 - protein, 334 aa, Neisseria; identical to SEQ ID NO: 415

SEQ ID NO: 1130 - protein, 392 aa, Neisseria; identical to SEQ ID NO: 416

SEQ ID NO: 1131 - protein, 265 aa, Neisseria
MKTKLIKILTPFTVLPLLACGQTPVSNANAESAVKAESAGKSVAASLKARLEKTYSAQDLKVLSVSETPVKGIYEVVVSGRQIIYTDAEGGYMFVGELINIDTRKNLTEERAADLNKIDFASLPLDKAIKEVRGNGKLKVAVFSDPDCPFCKRLEHEFEKMTDVTVYSFMMPIAGLHPDAARKAQILWCQPDRAKAWTDWMRKGKFPVGGSICDNPVAETTSLGEQFGFNGTPTLRLPQRAHPKRLQPDAPTGGNHPQKPAVNPQ

SEQ ID NO: 1132 - protein, 260 aa, Neisseria
MKTKLIKILTPFTVLPLLACGQTPVSNANAEPAVKAESAGKSVAASLKARLEKTYSAQDLKVLSVSETPVKGIYEVVVSGRQIIYTDAEGGYMFVGELINIDTRKNLTEERAADLNKIDFASLPLDKAIKEVRGNGKLKVAVFSDPDCPFCKRLEHEFEKMTDVTVYSFMMPIAGLHPDAARKAQILWCQPDRAKAWTDWMRKGKFPVGGSICDNPVAETTSLGEQFGFNGTPTLVFPNGRSQSGYSPMPQLEEIIRKNQ

SEQ ID NO: 1133 - protein, 260 aa, Neisseria; identical to SEQ ID NO: 1132

SEQ ID NO: 1134 - protein, 206 aa, Neisseria
MRITCAPMSLLSAAVWSVRAVRTSSNRFPAALRRYSAFRPTIFPKPAGTPWHRVRRFKSNRRTRGVKPLKKPYLARGAECRCRRAWTALSHNIAERARESPRRCGKRYADIGGDSDTIRIRVFRLEHRMSIYAVAHIIHLYCATAFVGGVFFEVLVLSVLHTGRVSREARREVEKAMSYRAVRVMPFAVGLLFARGTLESTAAACP

SEQ ID NO: 1135 - protein, 277 aa, Neisseria
MRITCAPMSLLSAAVWSIRVVRTSSNRFPAAFRRYSAFQPTIFPKPADTPWHRVRRFKSNRRMRGGKPLKKPYRPRGGGCRCRRAWTALSHNIAERARESPRRCGKRYADIGGDSDTIRIRVFRLEHRMSIYAVAHIVHLYCAIAFVGGVFFEVLVLSVLHTGRVSREARREVEKAMSYRAVRVMPFVVGLLFASGIVMAANRYLSILGEPFATSFGTMLTLKILLAFSVLAHFAIAVVKMARSTLTVGWSKYIHAVVFTHMLLIVFLAKAMFYISW

SEQ ID NO: 1136 - protein, 277 aa, Neisseria
MRITCAPMSLLSAAVWSIRAVRTSSNRFPAAFRRYSAFRPTIFPKPAGTPWHRVRRFKSNRRTRGGKPLKKTYRPRRAECRCRRARTALSHNIAERARESPRRYGKRYADIGDDSDTIRIRVFRLEYRMSIYAVAHIVHLYCAIAFVGGVFFEVLVLSVLHTGRVSCEARREVEKAMSYRAVRVMPFVVGLLFASGIVMAANRYLSILGEPFATSFGTMLTLKILLAFSVLAHFAIAVVKMARSTLTVGWSKYIHTVVFTHMLLIVFLAKAMFYISW

SEQ ID NO: 1137 - protein, 294 aa, Neisseria
MLGMARHDGQQGIAAILLPRRQQFFRLVFAPINARAAAHGNRPASDAFFKLPRQRFHVFRRHQVVFGIAAHLHGCRAQFRQPRRIRLRLRQTARQRSGCGTDQAADFQITVQRFFRQPRIRQKQRHTRSPAFLHQIGPDFGFHQNAEHRAVFAQKLPYPRFFVIRKIAALRIGKQNLRGFPSRRGHLRHQQRRIGKTPPQLAYQGLGGTRFSDRNGVYPNRAGNGIRMRLAETLVPMRPVCRGTSGAFVQITPYPYRRKQPQYIIKPLEHLSISCKTNAVRTVRTAFRQRNQIS

SEQ ID NO: 1138 - protein, 294 aa, Neisseria
  VARIANT (1)...(294): Xaa = Any Amino Acid
MLGMARHDDQQRIAAILLPRRQQFFRLVFTPINARAAAHGNRPASDAFFKLPRQRFHLFRRYDVVFGIAAHLHGCRAQFRQPRRIRLCLRQTPRQRSGGRTDQAADFQITVQRFFRQPRIRQKQRHTRAPAFPHQVGPDFGFHQNAEHRAVFAQKLPYPRFFVIRKIAALRIGKQNLRGFPPRRGHLRHQQRRIGKTPPQLAYQGLGGTRFSDRNGVYPNRAGNGIRIRLAETLVPMRPICRGTSGAFVQITPYPYRRKQPQYIIKPLEHLSISCKTNAVXTVQTAFRQRNQIS

SEQ ID NO: 1139 - protein, 293 aa, Neisseria
MLGMARHDDQQGIAAILLPRRQQFFRLVFTPINARAAAHGNLPVSDAFFKLPRQRFHLFRRHQVVFGIAAHLHGCRAQFRQPRRIRLRLCQTARQRSGGRTDQAADFQITVRFFRQPRIRQKQRHTRAPAFLHQIGPDFGFHQNAEHRAVFAQKLPYPRFFVIRKIAALCIRKQNLRGFPSRRGHLRHQQRRIGKTLPQLAYQRLGGTRFPDRNGVYPNRAGNGIRIRLAETLAPMRPICRGTSGAFVQITPYPYRRKQPQYIIKPLEHLSISCKTNAVRTVRTAFRQRNQIS

SEQ ID NO: 1140 - protein, 380 aa, Neisseria
LSWGGNGVQTAYWVQEAVQPGDSLADVLARSGMARDEIARITEKYGGEADLRHLRADQSVHVLVGGDGSAREVQFFTDEDGERNLVALEKKGGIWRRSASDADMKVLPTLRSVVVKTSARGSLARAEVPVEIRESLSGIFAGRFSLDGLKEGDAVRLLYDSLYFHGQQVAAGDILAAEVVKGGTTHQAFYYRSDKEGGGGGNYYDEDGRVLQEKGGFNIEPLVYTRISSPFGYRMHPILHTWRLHTGIDYAAPQGTPVRASADGVITFKGRKGGYGNAVMIRHANGVETLYAHLSAFSQAQGNVRGGEVIGFVGSTGRSTGPHLHYEARINGQPVNPVSVALPTPELTQADKAAFAAQKQKADALLARLRGIPVTVSQSD

SEQ ID NO: 1141 - protein, 430 aa, Neisseria
MAVFPLSAKHRKYALRALAVSIILVSAAYIASTERTERVRPQRVEQNLPPLSWGGSGVQTAYWVQEAVQPGDSLADVLARSGMARDEIARITEKYGGEADLRHLRADQSVHVLVGGDGGAREVQFFTDEDGERNLVALEKKGGIWRRSASEADMKVLPTLRSVVVKTSARGSLARAEVPVEIRESLSGIFAGRFSLDGLKEGDAVRLMYDSLYFHGQQVAAGDILAAEVVKGGTRHQAFYYRSDKEGGGGGNYYDEDGKVLQEKGGFNIEPLVYTRISSPFGYRMHPILHTWRLHTGIDYAAPQGTPVRASADGVITFKGRKGGYGNAVMIRHANGVETLYAHLSAFSQAEGNVRGGEVIGFVGSTGRSTGPHLHYEARINGQPVNPVSVALPTPELTQADKAAFAAQKQKADALLARLRGIPVTVSQSD

SEQ ID NO: 1142 - protein, 430 aa, Neisseria
MAVFPLSAKHRKYALRALAVSIILVSAAYIASTERTERVRPQRVEQKLPPLSWGGSGVQTAYWVQEAVQPGDSLADVLARSGMARDEIARITEKYGGEADLRHLRADQSVHVLVGGDGGAREVQFFTDEDGERNLVALEKKGGIWRRSASEADMKVLPTLRSVVVKTSARGSLARAEVPVEIRESLSGIFAGRFSLDGLKEGDAVRLIYDSLYFHGQQVAAGDILAAEVVKGGTRHQAFYYRSDKEGGGGGNYYDEDGRVLQEKGGFNIEPLVYTRISSPFGYRMHPILHTWRLHTGIDYAAPQGTPVRASADGVITFKGRKGGYGNAVMIRHANGVETLYAHLSAFSQAEGNVRGGEVIGFVGSTGRSTGPHLHYEARINGQPVNPVSVALPTPELTQADKAAFAAQKQKADALLARLRGIPVTVSQSD

SEQ ID NO: 1143 - protein, 327 aa, Neisseria
MKNFLSLFASILMSALIAVWFSQNPINAYWQQTYHRNSPLEPLAAYGWWRSGAALQENAYALSDGIKTFLSGETPPTAQDGGSADMPPEAAASEAAPPAGGTEWKQGTEAAAVRSGDKVFFAGDSLMQGVAPFVQKSLKQQYGIESANLSKQSTGLSYPSFFDWPKTIEETLKKHPEISVLAVFLGPNDPWDFPVGKRYLKFASDEWAQEYLKRVDRILEAAHTHRVQVVWLGIPYMKKVKLDGQMRYLDKLLSEHLKGKIILIPTAQTLSGGKGRYTDSVNVNGKPVRYRSKDGIHFTAEGQKLLAEKIMEKIVFEPSTQPSSTQP

SEQ ID NO: 1144 - protein, 327 aa, Neisseria
MKNFLSLFSSILMSALIAVWFSQNPINAYWQQTYHRNSPLEPLAAYGWWRSGAALQENAYALSDGIKAFLSGETPPTAQDGGSADMPSEAAASEAVPQTGETEWKQDTEAAAVRSGDKVFFVGDSLMQGVAPFVQKSLKQQYGIESVNLSKQSTGLSYPSFFDWPKTIEETLQKHPEISVLAVFLGPNDPWDFPVGKLYLKFASDEWAQEYLKRVDRILEAAHTHRVQVVWLGIPYMKKAKLDGQMRYLDKLLSEHLKGKIILIPTTHTLSGGKDRYTDSVNVNGKPVRYRSKDGIHFTAEGQKLLAAKIMEKIVFEPSTQPSSTQP

SEQ ID NO: 1145 - protein, 327 aa, Neisseria
MKNFLSLFASILMSALIAVWFSQNPINAYWQQTYHRNSPLEPLAAYGWWRSGAALQENAYALSDGIKAFLSGETPPTAQDGGSADMPSEAAAPETAPQTGETEWKQNTEAAAVRTGDKVFFAGDSLMQGVAPFVQKSLKQQYGIESVNLSKQSTGLSYPSFFDWPKTIEETLKKHPEISVLAVFLGPNDPWDFPVGKRYLKFASDEWAQEYLKRVDRILEAAHTHYVQVVWLGIPYMKKAKLDGQMRYLDKLLSEYLKGKIILIPTAHTLSGGKDRYTDSVNVNGKPVRYRSKDGIHFTAEGQKLLAAKIMEKIVFEPSTQPSSTQP

SEQ ID NO: 1146 - protein, 397 aa, Neisseria
MNPKHFIAFSALFAATQAEALPVASVSPDTVTVSPSAPYTDTNGLLTDYGNAAASPWMKKLRSVAQGSGEAFRILQIGDSHTAGDFFTDALRKRLQKTWGDGGIGWVYPANVKGQRMAAVRHSGNWQSFTSRNNTGDFPLGGILAQTGSGGGMTLTASDGKTGKQRVSLFAKPLLAEQTLTVNGNTVSANGGGWQVLDTGAALPLAIQTEMPWDIGFINIENPAGGITVSAMGINGAQLTQWSKWRADRMNDLAQTGADLVILSYGTNEAFNNNIDIADTEQKWLDTVRQIRDSLPAAGILIIGAPESLKNTLGVCGTRPVLLTEVQQMQRRVARQGQTMFWSWQNAMGGICSMKNWLNQGWAAKDGVHFSAQGYRRAAEMLADSLEELVRAAAIRQ

SEQ ID NO: 1147 - protein, 397 aa, Neisseria
MNPKHLIAFSALFAATQAEALPVASVSLDTVTVSPSAPYTDTNGLLTDYGNASASPWMKKLQSVAQGSGETFRILQIGDSHTAGDFFTDSLRKRLQKTWGDGGIGWVYPANVKGQRMAAVRHNGNWQSLTSRNNTGDFPLGGILAHTGSGGSMTLTASDGIASKQRVSLFAKPLLAEQTLTVNGNTVSANGGGWQVLDTGAALPLTIHTEMPWDIGFINIENPAGGITVSAMGINGAQLTQWSKWRADRMNDLAQTGADLVILSYGTNEAFNNNIDIADTEQKWLDTVRQIRDSLPAAGILIIGAPESLKNTLGVCGTRPVRLTEVQQMQRRVARQGQTMFWSWQNAMGGICSMKNWLNQGWAAKDGVHFSAKGYRRAAEMLADSLEELVRSAAIRQ

SEQ ID NO: 1148 - protein, 397 aa, Neisseria
MNPKHLIAFSALFAATQAEALPVASVSLDTVTVSPSAPYTDTNGLLTDYGNASASPWMKKLQSVAQGSGETFRILQIGDSHTAGDFFTDSLRKRLQKTWGDGGIGWVYPANVKGQRMAAVRHNGNWQSLTSRNNTGDFPLGGILAHTGSGGSMTLTASDGIASKQRVSLFAKPLLAEQTLTVNGNTVSANGGGWQVLDTGAALPLTIHTEMPWDIGFINIENPAGGITVSAMGINGAQLTQWSKWRADRMNDLAQTGADLVILAYGTNEAFGDNIDIADTEQKWLDTVRQIRDSLPAAGILIIGAPESLKNTLGVCGTRPVRLTEVQQMQRRIARQGQTMFWSWQNAMGGVCSMKNWLNHGWAAKDGVHFSAKGYQRSAEMLADSLEELVRSAAIRQ

SEQ ID NO: 1149 - protein, 533 aa, Neisseria
MHSIYFFKEKQMSQTDARRSGRFLRTVEWLGNMLPHPVTLFIIFIVLLLIASAVGAYFGLSVPDPRPVGAKGRADDGLIHVVSLLDADGLIKILTHTVKNFTGFAPLGTVLVSLLGVGIAEKSGLISALMRLLLTKSPRKLTTFMVVFTGILSNTASELGYVVLIPLSAVIFHSLGRHPLAGLAAAFAGVSGGYSANLFLGTIDPLLAGITQQAAQIIHPDYVVGPEANWFFMAASTFVIALIGYFVTEKIVEPQLGPYQSDLSQEEKDIRHSNEITPLEYKGLIWAGVVFVALSALLAWSIVPADGILRHPETGLVAGSPFLKSIVVFIFLLFALPGIVYGRITRSLRGEREVVNAMAESMSTLGLYLVIIFFAAQFVAFFNWTNIGQYIAVKGAVFLKEVGLGGSVLFIGFILICAFINLMIGSASAQWAVTAPIFVPMLMLAGYAPQVIQAAYRIGDSVTNIITPMMSYFGLIMATVIKYKKDAGVGTLISMMLPYSAFFLIAWIALFCIWVFVLGLPVGPGTPTFYPVP

SEQ ID NO: 1150 - protein, 526 aa, Neisseria
  VARIANT (1)...(526): Xaa = Any Amino Acid
MHSIYFFKEKQMSQTDTQRDGRFLRTVEWLGNMLPHPVTLFIIFIVLLLIASAVGAYFGLSVPDPRPVGAKGRADDGLIYIVSLLNADGFIKILTHTVKNFTGFAPLGTVLVSLLGVGIAEKSGLISALMRLLLTKSPRKLTTFMVVFTGILSNTASELGYVVLIPLSAIIFHSLGRHPLAGLAAAFAGVSGGYSANLFLSTIDPLLACITHQAAVVGPEANWFFMVASTFVIALIGYFVTEKIVEPQLGPYQSDLSQEEKDIRHSNEITPLEYKGLIWAGVVFVALSALLAWSIVPADGILRHPETGLVSGSPFLKSIVVFIFLLFALXGXVYGRVTRSLRGEQEVVNAMAESMSTLXLXLXXIFFAAQFVAFFNWTNIGQYIAVKGATFLKEVGLGGSVLFIGFILICAFINLMIGSASAQWAVTAPIFVPMLMLAGYAPEVIQAAYRIGDSVTNIITPMMSYFGLIMATVIKYKKDAGVGTLISMMLPYSAFFLIAWIALFCIWVFVLGLPVGPGAPTFYPAP

SEQ ID NO: 1151 - protein, 533 aa, Neisseria
MHSIYFFKEKQMSQTDTQRDGRFLRTVEWLGNMLPHPVTLFIIFIVLLLIASAAGAYFGLSVPDPRPVGAKGRADDGLIHVVSLLDADGLIKILTHTVKNFTGFAPLGTVLVSLLGVGIAEKSGLISALMRLLLTKSPRKLTTFMVVFTGILSNTASELGYVVLIPLSAIIFHSLGRHPLAGLAAAFAGVSGGYSANLFLGTIDPLLAGITQQAAQIIHPDYVVGPEANWFFMVASTFVIALIGYFVTEKIVEPQLGPYQSDLSQEEKDIRHSNEITPLEYKGLIWAGVVFVALSALLAWSIVPADGILRHPETGLVSGSPFLKSIVVFIFLLFALPGIVYGRVTRSLRGEQEVVNAMAESMSTLGLYLVIIFFAAQFVAFFNWTNIGQYIAVKGATFLKEVGLGGSVLFIGFILICAFINLMIGSASAQWAVTAPIFVPMLMLAGYAPEVIQAAYRIGDSVTNIITPMMSYFGLIMATVIKYKKDAGVGTLISMMLPYSAFFLIAWIALFCIWVFVLGLPVGPGAPTFYPAP

SEQ ID NO: 1152 - protein, 273 aa, Neisseria
MDFLIVLKALMMGLVEGFTEFLPISSTGHLIVFGNLIGFHSNHKVFEIAIQLGAVLAVVFEYRQRFSNVLHGVGKDRKANRFVLNLAIAFIPAAVMGLLFDKQIKEYLFNPLSVAVMLVLGGFFILWVEKRQSRAEPKIADVDALRPIDALMIGVAQVFALVPGTSRSGSTVMGGMLWGIERKTATEFSFFLAVPMMVAATAYDVLKHYRFFTLHDVGLILIGFIAAFVSGLVAVKALLKFVSKKNYIPFAYYRIVFGIVIIILWLSGWISWE

SEQ ID NO: 1153 - protein, 244 aa, Neisseria
  VARIANT (1)...(244): Xaa = Any Amino Acid
MDFLIVLKALMMGLVEGFTEFLPISSTGHLIVFGNLIGFHSNHKVFEIAIQLGAVLAVVFEYRQRFSNVLHGLGKDRKANRFVLNLAIAFIPAAVMGLLFGXQIKEXLFNPLSVAVMLVLXGFXILWVEKRQSRAEPKIADVDALRPIDALMIGVAQVFALVPGTSRSGSTIMGGMLWGIERKTATEFSFFLAVPMMVAATAYDVLKHYRFFTLHDVGLILIGFIAAFVSGLVAVKALLRFVSG

SEQ ID NO: 1154 - protein, 273 aa, Neisseria
MDFLIVLKALMMGLVEGFTEFLPISSTGHLIVFGNLIDFHSNHKVFEITIQLGAVLAVVFEYRQRFSNVLHGVGKDRKANRFVLNLAIAFIPAAVMGLLFGKQIKEYLFNPLSVAVMLVLGGFFILWVEKRQSRAEPKIVDVDALRPIDALMIGVAQVFALVPGTSRSGSTIMGGMLWGIERKTATEFSFFLAVPMMVAATAYDVLKHYRFFTLHDVGLILIGFVAAFVSGLVAVKALLRFVSKKNYIPFAYYRIVFGIAIIILWLSGWISWE

SEQ ID NO: 1155 - protein, 267 aa, Neisseria; identical to SEQ ID NO: 225

SEQ ID NO: 1156 - protein, 252 aa, Neisseria
  VARIANT (1)...(252): Xaa = Any Amino Acid
GLFFGLILATVIIAGILFYLNQSGQNAFKIPASSKQPAETEILKPXNQXKEDIQPXPADQNALSEPDAATEAEQSDAEXAADKQPVADKADEVEEKAGEPEREEPDGQAVRKKALTEEREQTVREKAQKKDAETVKXQAVKPSKETEKKASKEEKKAAKEKVAPKPTPEQILNSGSIEKARSAAAKEVQKMKTPTRRKQRIICKWARMPTVRARKGSVPNWQSWAYLPRWSVIRRDIKRFTGCKAAICLPMR

SEQ ID NO: 1157 - protein, 266 aa, Neisseria
MFMNKFSQSGKGLSGFFFGLILATVIIAGILFYLNQSGQNAFKIPVPSKQPAETEILKPKNQPKEDIQPEPADQNALSEPDAAKEAEQSDAEKAADKQPVADKADEVEEKADEPEREKSDGQAVRKKALTEEREQTVGEKAQKKDAETVKKQAVKPSKETEKKASKEEKKAEKEKVAPKPTPEQILNSGSIEKARSAAAKEVQKMKTPTRRKQRIICKWARMPTAGARKGSVPNWQSWAYLPRWSVIRRDIKRFTGCKAAICLPMR

SEQ ID NO: 1158 - protein, 288 aa, Neisseria; identical to SEQ ID NO: 143

SEQ ID NO: 1159 - protein, 38 aa, Neisseria
QWLKDVTEAYNSDAFKAYAHKRFEGYKSPAAWNEGAAK

SEQ ID NO: 1160 - protein, 287 aa, Neisseria
  VARIANT (1)...(287): Xaa = Any Amino Acid
MKTFFKTLSAAALALILAACGGQKDSAPAASASAAADNGAAKKXIVFGTTVGDFGDMVKEQIQPELEKKGYTVKLVEFTDYVRPNLALAEGEXDINVFQHKPYLDDFKKEHNLDITEVFQVPTAPLGLYPGKLKSLEEVKDGSTVSAPNDPSNFARVLVMLDELGWIKLKXGINPLTASKADIAENLKNIKIVELEAAQLPRSRADVDFXVVNGXYAISSGMKLTEALFQEPSFAYVNWSAVKTADKDSQWLKDVTEAYNSDAFKAYAHKRFEGYKSPAAWNEGAAK

SEQ ID NO: 1161 - protein, 232 aa, Neisseria
MLNRVFYRILGVADNLYPCLSDFCFFTIIAGLPLQAVLWERRMMVRRLIIGISGASGFQYGVKALELLRAQDVETHLVVSKGAEMARASETDYTKDEVYALADFVHPIGNIGACIASGTFKTDGMLVAPCSMRTLASVAHGFGDNLLTRAADVVLKERRRLVLMVRETPLNLAHLDNMKRVTEMGGVVFPPVPAMYRKPQTADDIVAHSIAHTLSLFGIDTPDLAEWQGMAD

SEQ ID NO: 1162 - protein, 231 aa, Neisseria
  VARIANT (1)...(231): Xaa = Any Amino Acid
MLNRVFYRILGVADNLYPRLSDFCFFTIIAGLPLQAVLWERRMMVRRLIIGISGASGFQYGVKALELLRAQDVETHLVVSKGAEMARASETAYARDEVYALADFVHPIGNIGACIASGTFKTDGMLVAPCSMRTLASVAHGFGDNLLTRAADVVLKERRRLVLMVRETPLNLAHLDNMKRXTEMGGVVFPPVPAMYRKPQTADDIVAHSVAHALSLFGIDTPDSAEWQGMA

SEQ ID NO: 1163 - protein, 232 aa, Neisseria
  VARIANT (1)...(232): Xaa = Any Amino Acid
MLNRIFYRILGVADNLYPYLSDFCFFTIIAGLPLQAVLWERRMMVRRLIIGISGASGFQYGVKALXLLRAQDIETHLVVSKGAEMARASETXYARDXVYALADXVHPIGNIGACIASGTFKTDGMLVAPCSMRTLASVVHGFGDNLLTRAADVVLKERRRLVLMVRETPLNLAHLDNMXRVTEMGGVVFPPVPAMYRKPQTADDIVAHSVAHALSLFGIDTPDSAEWQGMAD

SEQ ID NO: 1164 - protein, 232 aa, Neisseria; identical to SEQ ID NO: 1161

SEQ ID NO: 1165 - protein, 232 aa, Neisseria
MLNRVFYRILGVADNLYPRLSDFCFFTIIAGLPLQAVLWERRMMVRRLIIGISGASGFQYGVKALELLRAQDVETHLVVSKGAEMARASETAYARDEVYALADFVHPIGNIGACIASGTFKTDGMLVAPCSMRTLASVAHGFGDNLLTRAADVVLKERRRLVLMVRETPLNLAHLDNMKRVTEMGGVVFPPVPAMYRKPQTADDIVAHSVAHALSLFGIDTPDSAEWQGMAD

SEQ ID NO: 1166 - protein, 232 aa, Neisseria; identical to SEQ ID NO: 1163
  VARIANT (1)...(232): Xaa = Any Amino Acid

SEQ ID NO: 1167 - protein, 455 aa, Neisseria; identical to SEQ ID NO: 150

SEQ ID NO: 1168 - protein, 389 aa, Neisseria
  VARIANT (1)...(389): Xaa = Any Amino Acid
MFSFGWVFDRPQYELGSLSPVAAVACRRALSRLGLDVQIKWPNDLVVGRDKLGGILIETVRTGGKTVAVVGIGINFVLPXEVENAASVQSLFQTASRRGNADAAVLLXXXXXXXXEISLRSDXRPVSVXKRRDSERFLLLDGGNSRLKWAWVENGTFATVGSAPYRDLSPLGAEWAEKADGNVRIVGCAVCGEFKKAQVQEQLARKIEWLPSSAQALFGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIYGLLNMIAAEGREYEH

SEQ ID NO: 1169 - protein, 455 aa, Neisseria
MFSFGWVFDRPQYELGSLSPVAAVACRRALSRLGLKTQIKWPNDLVVGRDKLGGILIETVRTGGKTVAVVGIGINFVLPKEVENAASVQSLFQTASRRGNADAAVLLETLLAELDAVLLQYARDGFAPFVAEYQAANRDHGKAVLLLRDGETVFEGTVKGVDGQGVLHLETAEGKQTVVSGEISLRSDDRPVSVPKRRDSERFLLLDGGNSRLKWAWVENGTFATVGSAPYRDLSPLGAEWAEKVDGNVRIVGCAVCGEFKKAQVQEQLARKIEWLPSSAQALGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIHGLLNLIAAEGGESEHT

SEQ ID NO: 1170 - protein, 592 aa, Neisseria; identical to SEQ ID NO: 151

SEQ ID NO: 1171 - protein, 592 aa, Neisseria; identical to SEQ ID NO: 148

SEQ ID NO: 1172 - protein, 592 aa, Neisseria; identical to SEQ ID NO: 149

SEQ ID NO: 1173 - protein, 451 aa, Neisseria
MSIQSGEILETVKMVADRNFDVRTITIGIDLHDCISTDIDVLNQNIYNKITTVGKDLVATAKHLSAKYGVPIVNQRISVTPIAQIAAATKADSYVSVAQTLDKAAKAIGVSFIGGFSALVQKGMSPSDEVLIRSVPEAMKTTDIVCSSINIGSTRAGINMDAVKLAGETIKRTAEITPEGFGCAKIVVFCNAVEDNPFMAGAFHGSGEADAVINVGVSGPGVVKAALENSDAVSLTEVAEVVKKTAFKITRVGELIGREASKMLNIPFGILDLSLAPTPAVGDSVARILEEMGLSVCGTHGTTAALALLNDAVKKGGMMASSAVGGLSGAFIPVSEDEGMIAAAEAGVLTLDKLEAMTAVCSVGLDMIAVPGDTPAHTISGIIADEAAIGMINSKTTAVRIIPVTGKTVGDSVEFGGLLGYAPVMPAKEGSCEVFVNRGGRIPAPVQSMKN

SEQ ID NO: 1174 - protein, 447 aa, Neisseria
  VARIANT (1)...(447): Xaa = Any Amino Acid
MSIQSGEILETVKMVADQNFDVRTITIGIDLHDCISSDINVLNQNIYNKITTVGKDLVTTAKYLSAKYGVPIVNQRISVTPIAQIAAATHADSYVSVAQTLDKAAKAIGVSFIGGFSALVQKGMSPSDEVLIRSIPEAMKTTDIVCXSINIGSTRAGINMDAVKLAGETVKRTAEITPEGFGCAKIVVFCNAVEDNPFXAGAFHGSGDAVINVGVSGPGVVKAALENSDATTLTEVAEVVKKTAFKITRVGELIGREASKMLNIPFGILDLSPTPPVGDSVARILEEMGLSVCGTHGTTAALALLNDAVKKGGMMASSAVGGLSGAFIPVSEDEGMIXAAEAGVLTLDKLEAMTAVCSVGLDMIAVPGDTPAHTISGIIADEAAIGMINSKTTAVRIIPVTGKTVGDTVEFGGLLGYAPVMPVKEGSCEVFVNRGGRIPAPVQSMKN

SEQ ID NO: 1175 - protein, 451 aa, Neisseria
MSIQSGEILETVKMVADQNFDVRTITIGIDLHDCISTDIDVLNQNIYNKITTVGKDLVATAKYLSAKYGVPIVNQRISVTPIAQIAAATHADSYVSVAQTLDKAAKAIGVSFIGGFSALVQKGMSPSDEVLIRSIPEAMKTTDIVCSSINIGSTRAGINMDAVRLAGETIKRTAEITLEGFGCAKIVVFCNAVEDNPFMAGAFHGSGEADAVINVGVSGPGVVKAALENSDATTLTEVAEVVKKTAFKITRVGELIGREASKMLNIPFGILDLSLAPTPAVGDSVARILEEMGLSVCGTHGTTAALALLNDAVKKGGMMASSAVGGLSGAFIPVSEDEGMIAAAEAGVLTLDKLEAMTAVCSVGLDMIAVPGDTPAHTISGIIADEAAIGMINSKTTAVRIIPVTGKTVGDSVEFGGLLGYAPVMPVKEGSCEVFVNRGGRIPAPVQSMKN

SEQ ID NO: 1176 - protein, 173 aa, Neisseria
MDDPRTYGSGNPGATNVLRSGKKKAAALTLLGDAAKGLVAVLLARVLQEPLGLSDSAIAAVALAALVGHMWPVFFGFKGGKGVATALGVLLALSPATALVCALIWLVMAFGFKVSSLAALVATTAAPLAALFFMPHTSWIFATLAIAILVLLRHKSNILNLIKGKESKIGEKR

SEQ ID NO: 1177 - protein, 173 aa, Neisseria
MDDPRTYGSGNPGATNVLRSGKKKAAALTLLGDAAKGLVAVLLARVLQEPLGLSDSAIAAVALAALVGHMWPVFFGFKGGKGVATALGVLLALSPATALVCALIWLVMAFGFKVSSLAALTATIAAPVAASFFMPHVSWVWATVAIALLVLFRHKSNIVKLLEGRESKIGGSR

SEQ ID NO: 1178 - protein, 173 aa, Neisseria
MDDPRTYGSGNPGATNVLRSGKKKAAALTLLGDAAKGLVAVLLARVLQEPLGLSDSAIAAVALAALVGHMWPVFFGFKGGKGVATALGVLLALSPTTALVCALIWLVMAFGFKVSSLAALTATIAAPLAALFFMPHTSWIFATLAIAILVLLRHKSNILNLIKGKESKIGEKR

SEQ ID NO: 1179 - protein, 203 aa, Neisseria
MKLQQLAEEKIGVLIVFTLLVVSVGLLIEVVPLAFTKAATQPAPGVKPYNALQVAGRDIYIREGCYNCHSQMIRPFRAETERYGHYSVAGESVYDHPFQWGSKRTGPDLARVGGRYSDEWHRIHLLNPRDVVPESNMPAFPWLARNKVDVDATVANMKALRKVGTPYSDEEIAKAPEALANKSELDAVVAYLQGLGLALKNVR

SEQ ID NO: 1180 - protein, 203 aa, Neisseria; identical to SEQ ID NO: 1179

SEQ ID NO: 1181 - protein, 203 aa, Neisseria
MKLQQLAEEKIGVLIVFTLLVVSVGLLIEVVPLAFTKAATQPASGVKPYNALQVAGRDIYIREGCYNCHSQMIRPFRAETERYGHYSVAGESVYDHPFQWGSKRTGPDLARVGGRYSDEWHRIHLLNPRDVVPESNMPAFPWLARNKVDVDATVANMKALRKVGTPYSDEEIAKAPEALANKSELDAVVAYLQGLGLALKNVR

SEQ ID NO: 1182 - protein, 497 aa, Neisseria
MDMVNTKPNTSVINMLSFLTGLLSLGIEVLWVRMFSFAAQSVPQAFSFILACFLTGIAVGAYFGKRICRSRFVDIPFIGQCFLWAGIADFLILGAAWLLTGFSGFVHHAGIFITLSAVVRGLIFPLVHHVGTDGNKSGRQVSNVYFANVAGSALGPVLIGFVILDLLSTQQIYLLICLISAAVPLFCTLFQKSLRLNAVSVAVSLMFGILMFLLPDSVFQNIAGRPDRLIENKHGIVAVYHRDGDKVVYGANVYDGAYNTDIFNSVNGIERAYLLPSLKSGIRRIFVVGLSTGSWARVLSAIPEMQSMIVAEINPAYRSLIADEPQIAPLLQDKRVEIVLDDGRKWLRRHPDEKFDLILMNSTWYWRAYSTNLLSAEFLKQVQSHLTPDGIVMFNTTHSPHAFATAVHSIPYAYRYGHMVVGSATPVVFPNKELLKQRLSRLIWPESGRHVFDSSTVDAAAQKVVSRMLIRMTEPSAGAEVITDDNMIVEYKYGRGI

SEQ ID NO: 1183 - protein, 497 aa, Neisseria
  VARIANT (1)...(497): Xaa = Any Amino Acid
MDIVNTKPNTSLIYMXSFLSGLLSLGIEVLWVRMFSFAAQSVPQAFSFTLACFLTGIAVGAYFGKRICRSRFVDIPFIGQCFLWAGIADFLILGAAWLLTGFSGFVHHAGIFITLSAVVXXLIFPLVHHVGTDGNKSGRQVSNVYFAXVAGSALGPVLIGFVILDFLSTQQIYLLICXISAAVPLFCTLFQKSLRLNAVSVAVSLMFGILMFLLPDSVFQNIADRPDRLIENKHGIVAVYHRDGDKVVYGANVYDGAYNTDVFNSVNGIERAYLLPSLKSGIRRIFVVGLSTGSWARVLSAIPEMQSMIVAEINPAYRSLIADEPQIAPLLQDKRVEIVLDDGRKWLRRHPDEKFDLILMNTTWYWRAYSTNLLSAEFLKQVQSHLTPDGIVMFNTTHSPHAFATAVHSIPYAYRYGHMVVGSATPVVFPNKELLKQRLSRLIWPESGRHVFDSSTVDAAAQKVVSRMLIQMTEPSAGAEVITDDNMIVEYKYGRGI

SEQ ID NO: 1184 - protein, 497 aa, Neisseria
MDIVNTKPNTSLIYMLSFLSGLLSLGIEVLWVRMFSFAAQSVPQAFSFTLACFLTGIAVGAYFGKRICRSRFVDIPFIGQCFLWAGIADFLILGAAWLLTGFSGFVHHAGIFITLSAVVRGLIFPLVHHVGTDGNKSGRQVSNVYFANVAGSALGPVLIGFVILDFLSTQQIYLLICLISAAVPLFCTLFQKSLRLNAVSVAVSLMFGILMFLLPDSVFQNIADRPDRLIENKHGIVAVYHRDGDKVVYGANVYDGAYNTDVFNSVNGIERAYLLPSLKSGIRRIFVVGLSTGSWARVLSAIPEMQSMIVAEINPAYRSLIADEPQIAPLLQDKRVEIVLDDGRKWLRRHPDEKFDLILMNTTWYWRAYSTNLLSAEFLKQVQSHLTPDGIVMFNTTHSPHAFATAVHSIPYAYRYGHMVVGSATPVVFPNKELLKQRLSRLIWPESGRHVFDSSTVDAAAQKVVSRMLIQMTEPSAGAEVITDDNMIVEYKYGRGI

SEQ ID NO: 1185 - protein, 320 aa, Neisseria; identical to SEQ ID NO: 73

SEQ ID NO: 1186 - protein, 320 aa, Neisseria; identical to SEQ ID NO: 71

SEQ ID NO: 1187 - protein, 320 aa, Neisseria; identical to SEQ ID NO: 72

SEQ ID NO: 1188 - protein, 558 aa, Neisseria
MVGRTLTADTDIFVLLAAGGDGKMQHHFDGRVAFVKRFGHQAAVSVEAEGQLGHVVRADGEAVEVLQELFRQYRVARQLAHHNQAQAVFAAFQAVFFQCLNHCFGFAQSADERNHDFDVGQTHFVTNAFQGFAFQGETVFEALGNITRRTTEAQHRVFFMRFVYAAADQVGVFVGFEVGHTDDGFTRINRCGKRCHAFGDFIDVEVDRGCVTGDAADNFRFQFVVLFVKFQQGFRVDADLAVDDKFHTRQADAFAGQIGEAECEFGIADVHHDFDGCFWHIVQGDIGNLYVQQAGIDKAGIAFGTGYGNFLTVFQEFGRIAAADDGRNTQFARDDGGVAGASAAVGHDGGSTFHHGFPIRIGHVGNQYVAGFDGIHLGSIFNQAHLALTDFLTDGTTFAQDGFFAVDGVAAQVAAAFFLGFDGFGAGLQDVEFAVQAVASPFDIHRAAVVFFDGQRVVCQLGDFFVGNGEAVAVFFGDFDVGYRFAGFGFVGENHFDVFRTHGLAQDGGFACFERGFEHIKFVRVDRALYDVFAQTVRGGNKDDLVVAGFGVEGEHHT

SEQ ID NO: 1189 - protein, 558 aa, Neisseria
  VARIANT (1)...(558): Xaa = Any Amino Acid
MVGXALTADADIFVLLAAGGDGKVQHHFDGRVAFVKRFGYQAAVAVETEGQLGHVVRADGEAVEVLQELFRQYRVARQLAHHNQAQAVFAAFQAVFFQGFDNGFGFAQSADERNHDFNVGQPHFIADAFQGFAFQGETVFEVVGDITRRTTEAQHRVFFMRFVYVAADQVGVFVGFEVGHTDDGFTRINRCGQCRHAFGDFIDVEVDRGRVTGDTAGNFRFXFVVLFVKFQQXFGVDTDLAVDDKFHTRQADAFAGQVGEAECEFGIADVHHDFYRCFRHIVXGDIGNLYVQQTGIDKAGIAFGTGYGNFLTVFQQFGCIAAADNGRNAQFTRDDGGVAGTAAAVGNDGRSTFHHGFPIRIGHVGNEYVAGFDGIHLGSIFNQAHLALTDFLTDGAAFAXYGFVAVDGEAAQVAVALFLGFYGFGTGLQDVEFAVQAVASPFDIHRAAVVFFDGQCVMRQLSNFFVGNGEAVAVFLGDIDVGYGFTGFCFVGKNHFDVFXTHGFTQDGGLARFERGFEHXKFVRVDRTLYDVFAQTVRGGNKDDLIVXGFGVEGEHHT

SEQ ID NO: 1190 - protein, 554 aa, Neisseria
MVGRALTADADIFVLLAAGGDGKVQHHFDGRVAFVKRFGYQAAVAVETEGQLGHVVRADGEAVEVLQELFRQYRVARQLAHHNQAQAVFAAFQAVFFQGFDNGFGFAQSADERNHDFNVGQPHFIADAFQGFAFQGETVFEVVGDITRRTTEAQHRVFFMRFVYVAADQVGVFVGFEVGHTDDGFTRINRCGQCRHAFGDFIDVEVDRGRVTGDTAGNFRFFVVLFVKFQQGFGVDTDLAVDDKFHTRQADAFAGQVGEAECEFGIADVHHDFYRCFRHVVQSNIGNLYVQQAGVDEAGIAFGTGYGNFLTVFQQFGCIAAADNGRNTQFARDDGGVAGTSAPVGHDGGSAFHHRFPIWVGHVGNQYVAGFDGIHLGSIFNQAYLALTDFLTDGAAFAQDGFFAVDRKAAQVAAAFFLGFDGFGTGLQDVEFAVQAVASPFDVHRAAVVFFDGQCVMRQLGDFFVGNGEAVAVFFGDIDVGYRFAGFCFVGKNHFDVFAHGFAQDGRFACFQRGFEHIEFVGIDCALYDVFAQTVGSDKDDLVVTGFGIEGEHH

SEQ ID NO: 1191 - protein, 168 aa, Neisseria
MMKPHNLFQFLAVCSLTVAVASAQAGAVDALKQFNNDADGISGSFTQTVQSKKKTQTAHGTFKILRPGLFKWEYTLPYRQTIVGDGQTVWLYDVDLAQVTKSSQDQAIGGSPAAILSNKTALESSYTLKEDGSSNGIDYVRGNAQTQQRRLPIHPHRLQRRQPRRHAA

SEQ ID NO: 1192 - protein, 168 aa, Neisseria
  VARIANT (1)...(168): Xaa = Any Amino Acid
MMKPHNLFQFLAVCSLTVAVASAQAGAVDALKQFNNDADGISGSFTQXVQXKKKTQTAHGTFKILRPGLFKWEYTKLYRQTIVGDGQTVWLYDVDLAQVTKSSQDQAIGXSPAAILSNKXALESSYTLKEDGSSNGIDYVGNAQTQQRRLPIHPHRLQRRQPRRHAAX

SEQ ID NO: 1193 - protein, 167 aa, Neisseria
MMKPHNLFQFLAVCSLTVSVASAQAGAVDALKQFNNDADGISGSFTQTVQSKKKTQTAHGTFKILRPGLFKWEYTSPYKQTIVGDGQTVWLYDVDLAQVTKSSQDQAIGGSPAAILSNKTALESSYTLKEDGSSNGIDYVGNAQTQQRRLPIHPHRLQRRQPRRHAA

SEQ ID NO: 1194 - protein, 207 aa, Neisseria
MMKPHNLFQFLAVCSLTVAVASAQAGAVDALKQFNNDADGISGSFTQTVQSKKKTQTAHGTFKILRPGLFKWEYTLPYRQTIVGDGQTVWLYDVDLAQVTKSSQDQAIGGSPAAILSNKTALESSYTLKEDGSSNGIDYVRATPKRNNAGYQYIRIGFKGGNLAAMQLKDSFGNQTSISFGGLNTNPQLSRGAFKFTPPKGVDVLSN

SEQ ID NO: 1195 - protein, 207 aa, Neisseria
MMKPHNLFQFLAVCSLTVAVASAQAGAVDALKQFNNDADGISGSFTQTVQSKKKTQTAHGTFKILRPGLFKWEYTKPYRQTIVGDGQTVWLYDVDLAQVTKSSQDQAIGGSPAAILSNKTALESSYTLKEDGSSNGIDYVLATPKRNNAGYQYIRIGFKGGNLAAMQLKDSFGNQTSISFGGLNTNPQLSRGAFKFTPPKGVDVLSN

SEQ ID NO: 1196 - protein, 207 aa, Neisseria
MMKPHNLFQFLAVCSLTVSVASAQAGAVDALKQFNNDADGISGSFTQTVQSKKKTQTAHGTFKILRPGLFKWEYTSPYKQTIVGDGQTVWLYDVDLAQVTKSSQDQAIGGSPAAILSNKTALESSYTLKEDGSSNGIDYVLATPKRNNAGYQYIRIGFKGGNLAAMQLKDSFGNQTSISFGGLNTNPQLSRGAFKFTPPKGVDVLSN

SEQ ID NO: 1197 - protein, 68 aa, Neisseria
MSAPSASVIILFHAASISASSCSGKGVSKIHWRISLPTRASSETSSTSNFARAAEMRSFRPLCARNAR

SEQ ID NO: 1198 - protein, 68 aa, Neisseria
MSAPPASATILFHAASISASSCSGKGVSKIHWRISLPTRASSATSSTSNFASAAEMRSLRPLCARNAR

SEQ ID NO: 1199 - protein, 207 aa, Neisseria
ATGTCCGCGCCGCCGGCATCGGCAACCATTTTGTTCCATGCCGCTTCGATTTCGGCATCGAGCTGTTCGGGGAAGGGCGTGTCCAAAATCCATTGGCGGATTTCTTTGCCGACGCGTGCCAGTTCGGCAACGTCTTCGACATCTAATTTTGCCAGTGCGGCGGAAATGCGTTCGCTCAGACCGTTGTGTGCGAGGAATGCGCGGTAG

SEQ ID NO: 1200 - protein, 119 aa, Neisseria
MARSLYREAKTWRIAFLTLSKPLIFRKVSCWPANDASGRSSAVAEERTATEMSAPSASVIILFHAASISASSCSGKGVSKIHWRISLPTRASSETSSTSNFARAAEMRSFRPLCARNAR

SEQ ID NO: 1201 - protein, 119 aa, Neisseria
MARSLYREANTWCIASLTLSKPLMFKKVSCCPANDASGRSSAVAEERTATEMSAPPASATILFHAASISASSCSGKGVSKIHWRISLPTRASSATSSTSNFASAAEMRSLRPLCARNAR

SEQ ID NO: 1202 - protein, 119 aa, Neisseria
MARSLYREANTWRIASLTFSKPLIFRKVSCWPANDASGRSSAVAEERTATEMSAPPASATILFHAASISASSCSGKGVSKIHWRISLPTRASSATSSTSNFASAAEMRSLRPLCARNAR

SEQ ID NO: 1203 - protein, 424 aa, Neisseria
MLVQDLPFEVKLKKFHIDFYNTGMPRDFASDIEVTDKATGEKLERTIRVNHPLTLHGITIYQASFADGGSDLTFKAWNLRDASREPVVLKATSIHQFPLEIGKHKYRLEFDQFTSMNVEDMSEGAEREKSLKSTLNDVRAVTQEGKKYTNIGPSIVYRIRDAAGQAVEYKNYMLPILQDKDYFWLTGTRSGLQQQYRWLRIPLDKQLKADTFMALREFLKDGEGRKRLVADATKDAPAEIREQFMLAAENTLNIFAQKGYLGLDEFITSNIPKGQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVFMFYVPKKRAWVLFSNKIRFAMSSARSERDLQKEFPKHVESLQRLGKDLNHD

SEQ ID NO: 1204 - protein, 425 aa, Neisseria
  VARIANT (1)...(425): Xaa = Any Amino Acid
ILVQDLPFEVKLKKFHIDFYNTGMPRDFASDIEVTDKATGEKLERTIRVNHPLTLHGITIYQASFADGGSDLTFKAWNLGDASREPVVLKATSIHQFPLEIGKHKYRLEFDQFTSMNVEDMSEGAEREKSLKSTLXDVRAVTQEGKKYTNIGPSIVYRIRDAAGQAVEYKNYMLPVLQEQDYFWITGTRSGLQQQYRWLRIPLDKQLKADTFMALREFLKDGEGRKRLVADATKGAPAEIREQFMLAAENTLNIFAQKGYLGLDEFITSNIPKEQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVLMFYVREKRAWVLFSDGKIRFAMSSARSERDLQKEFPKHVESLQRLGKDLNHD

SEQ ID NO: 1205 - protein, 425 aa, Neisseria
ILVQDLPFEVKLKKFHIDFYNTGMPRDFASDIEVTDKATGEKLERTIRVNHPLTLHGITIYQASFADGGSDLTFKAWNLGDASREPVVLKATSIHQFPLEIGKHKYRLEFDQFTSMNVEDMSEGAEREKSLKSTLNDVRAVTQEGKKYTNIGPSIVYRIRDAAGQAVEYKNYMLPVLQEQDYFWITGTRSGLQQQYRWLRIPLDKQLKADTFMALREFLKDGEGRKRLVADATKGAPAEIREQFMLAAENTLNIFAQKGYLGLDEFITSNIPKEQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVLMFYVREKRAWVLFSDGKIRFAMSSARSERDLQKEFPKHVESLQRLGKDLNHD

SEQ ID NO: 1206 - protein, 297 aa, Neisseria; identical to SEQ ID NO: 317

SEQ ID NO: 1207 - protein, 288 aa, Neisseria
  VARIANT (1)...(288): Xaa = Any Amino Acid
MFRLQFRLFPPLRTAMHILLTALLKCLSLLPLSCLHTLGNRLGHLAFYLLKEDRARIVANMRQAGLNPDPKTVKAVFAETAKGGLELAPAFFRKPEDIETMFKAVHGWEHVQQALDKHEGLLFITPHIGSYDLGGRYISQQLPFPLTAMYKPPKIKAIDKIMQAGRVRGKGKTAPTSIQGVKQIIKALRSGEATIVLPDHVPSPQEGGEGVWVDFFGKPAYTMTLAAXLAHVKGVKTLFFCCERLPGGQGFDLHIRPVQGELNGDKAHDAAVFNRNAEYWIRRFPTHI

SEQ ID NO: 1208 - protein, 298 aa, Neisseria
MFRLQFRLFPPLRTAMHILLTALLKCLSLLPLSCLHTLGNRLGHLAFYLLKEDRARIVANMRQAGMNPDPKTVKAVFAETAKGGLELAPAFFRKPEDIETMFKAVHGWEHVQQALDKHEGLLFITPHIGSYDLGGRYISQQLPFPLTAMYKPPKIKAIDKIMQAGRVRGKGKTAPTSIQGVKQIIKALRSGEATIVLPDHVPSPQEGGEGVWVDFFGKPAYTMTLAAKLAHVKGVKTLFFCCERLPGGQGFDLHIRPVQGELNGDKAHDAAVFNRNAEYWIRRFPTQYLFMYNRYKMP

SEQ ID NO: 1209 - protein, 298 aa, Neisseria; identical to SEQ ID NO: 315

SEQ ID NO: 1210 - protein, 520 aa, Neisseria
MAVFDEVGRIAHGCGGVVKQSLFLRVVHQVEQGARLAEVVVIVLAVVPVCRVAVDFQRRFGEVGLLLPLAEAVGFVVRQAAVVAVGAALSVALVAVNRATRTIDGDLAEVHTQAVTLRVGVIEQTGLQHFIRARADTGNEVARCEGGLFHIGEEVFGIAVQLEFAHFNQRIVFFRPNFGQVKRMIRHFFGIGFRHDLDVHRPFRELAALDGFVQVALMAFAVVGDDFCSFFVGQVFNPLLAAEMEFHPKTFARFVPEAVGMRTEAVHMAVAGGNTAVAHHDGNLVQGFGQQRPEVPVVCGGTHIGARIAFDGFVQVGEFARVAQEEHGRVVADHIPVAFFGIEFQRKTADVAFRIGCAALACHGGETGEHLGFFADFAENFGAGVFGDVVCYGKRTERARTFGVHTAFGDDFAHEVGEFFIQPQILRQQGAARAGGQAVLIVGNGRAVVHGQMGYGAFGGSHRSCSFSQVGQMGGKRLTVRFGGKRIRNRFLDCNKFLESTFYFPFAKTMDAIIRQDFRY

SEQ ID NO: 1211 - protein, 520 aa, Neisseria
  VARIANT (1)...(520): Xaa = Any Amino Acid
MAVFDEVGRVAHCGGGVAEQCLFLRVVHQVEQGARLAEIVVIVLAVVPVCRVAVDFQRRFGESGLLLPLAEAVGFVVRQAAXVAVGAALPVAXXAVNXATRTIDGNLAEVYAQTVALCVGVIEQTRLQHFIXAGADTGNEVARCEGGLFHIGEEVFGIAVQLEFAHFNQRIVFFRPNFGQVKRMIRYFFRVCFRHDLDVHRPFRKLAAFDGFXXVALMAFAVVGDDFGGFFVGQVFNALLGAEMEFHPKTLACFVPEAVGMRTEAVHMAVAGGDAAVAHHDGNLVQCFGQQRPEVPVVCGRAHIGARVAFDGFVQVGELTRVAQEEHGRVVADHIPVAFFGIKFQGKTADVAFCIGCAAFACHGGETGEHLGFFADFAEDFGAGVFGDVVRYGKRTERARTFGVHTAFGDDFAHEVGEFFIQPQILRQQRAARTGGQAVLIVGNRRAVVHGQMGYRAFGGSHRSCSFSQVGQMGGKRLTVRFGGKRIRNRFLDCNKFLESTFYFPFVKTMDATIRQDFRY

SEQ ID NO: 1212 - protein, 520 aa, Neisseria
  VARIANT (1)...(520): Xaa = Any Amino Acid
MAVFDEVGRVAHCGGGVAEQCLFLRVVHQVEQGARLAEIVVIVLAVVPVRRVAVDFQRRFGEVGLLLPLAEAVGFVVRQAAVVAVGASLSVALVAVNRATRTVDRDLAEVHAQAVALRVGVIEQTRLQHFIWAGADTGNEVARCEGGLFHIGEEVFGIAVQLEFAHFNQRIVFFRPNFGQVKRMIRHFFRIGFRHDLDVHRPFRKLAALDGFVQVALMAFTVVGDDFGGFFVGQVFNALLGAEMEFHPKTLACFVPEAVGMRTEAVHMAVAGGDAAVAHHDGNLVQCFGQQRPEVPVVCGRAHIGARVAFDGFVQVGELTRVAQEEHGRVVADHIPVAFFGIELQRKTADVAFCIGCAAFACHGGETGEHLGFFADFAEDFGAGVFGDVVRYGKRTERARTFGVHTAFGDDFAHEVGEFFIQPQILRQQRAARTGGQAVLIVGNRRAVVHGQMGYRAFGGXHRSCSFSQVGQXGGKRLTVRFGGKRIRNRFLDCNKFLESTFYFPFVKTMDATIRQDFRY

SEQ ID NO: 1213 - protein, 185 aa, Neisseria
MLLPALQQGGGFLSGGGFGLVGQVQGLVFLLQTAFALFVLGNGLFGMGKLLLLQRQFAADAVCLVLLGLEGSVERGLDFFQFGQTLFVFGNLHRPFRQFGLLFFDLQLVFLKLHADLLLLLPDALQLRLRCLLVAFDALVQVLPVADLFFQTGNLLAQHAAFVAQFVYCLLLRLFGSLQGVYFVI

SEQ ID NO: 1214 - protein, 185 aa, Neisseria
  VARIANT (1)...(185): Xaa = Any Amino Acid
MLLLTLQQGGCFLRGGGFGFVGQVXGLVFLFQTTFALFVLGNRLFGMGKLLLLQRQFAADAVCLVLLGLEGGVERGLGFFQFGQTLLVFGNLHRPFRQLGLFFFDLQLVFFKLHADLLLLLMNALXLRLRCLLVAFDALVQVLLMADLFFQTGNLLAQHAALVAQFMHCLLLRLFGSLQGVYFVV

SEQ ID NO: 1215 - protein, 185 aa, Neisseria
MLLLALQQGGSFLRGGGFGFVRQIQGLVFLFQTTFALFVLGNGLFGMGKLLLLQRQFAADAVCLVLLGLEGGIECGLGFFQFGQTLFVFGNLHRPFRQFGLLFFRLQLVFFKLHADLLLLLMDALHLRLRRLLVAFDALVQVLLMADLFFQTGNLFAQHAAFVAQFVHRLLLRLFGSLQGVYFVV

SEQ ID NO: 1216 - protein, 167 aa, Neisseria
MVAFGVDQGLLLLQQGGLGGGLKLRQLGLQGLYAGVLLPALFLNLREFFLHGDVFFVQRVYGFGQLVELDVLLVVLELGFIGEGKLLPAFLPVQGLLFEPGDLLPVVLFLRVEFVDGDFGKPVLAVGFQQGKLRLFQTALLLLAAVRGGLLLVFEFGGGFLQSSDVV

SEQ ID NO: 1217 - protein, 167 aa, Neisseria
  VARIANT (1)...(167): Xaa = Any Amino Acid
MVAFGVDQGFLLLQQGGLGGGLKLRQLGLQGLHFSVLLPALFLNLREFLLHNNIFFVQGLYGFAXFFKLDVLLVVLELGFIGEGKLLLAFLPVEGLLFKLGDLLPVVLFLLVEFVDGDFGKPVLAVGFQQGKLRLFQTALLLLAAVRGGLLLVFEFGGGFLQGNDVV

SEQ ID NO: 1218 - protein, 167 aa, Neisseria
MVAFGVDQGFLLLQQGGLGGGLKLRQLGLQGLYAGVLFPTLLLNLREFLLYDNIFFVQTLYGFAQLFELDVLLVVLELGFIGEGKLLLAFLPIEGLLFKLGNLLLVVLFLLVELVDGDFGKPVLAVGFQQGKLRLFQTTLLLLAAVRGGLLLVFEFGGGFLQNGDVV

SEQ ID NO: 1219 - protein, 574 aa, Neisseria
MVAVCDERAVQRTLVAQFAQQGGLFLLFVQAVVVFQACVLEKLGNHIGVFACVLAQVERHHVEAEHGHGTDEVCQTAFGKQAAAVVDKGTLQFFQIIEKFLGRSIRLEKAEFAAHAQTERARFAHSARHNVGNGAAVRFFGAGDFFVRREGCQCHYVVVDFDAADGKRQFAVKFVEFAAVKTEHGIGVAAEGKAQGFARNKRIAVAVAADPAADFKDIRNADIGIGRLKVVFHLAVEFGQGFKKAHREDGHAVVDFVVDAEFVAARFAGLPQAQKHGVDFAAQPCQRVGIGAAFALRQQRADAAVEIQNGLALHFGRVRGQNGGNGRIVQLPLHRFAVGFPRFEPADGFRQAAFCCVVAGIFVDLAAAFVVHVFGDIQNLGEQPAGKRQIVGLPFVQLRQYFFNQCRAVVGSGQEFDRFDNQRRGFFVQEVEQGLFQKFRVRRQSRVLRIVQDMQLHDFPLIAVNTVNVPQMPHPCQTVHTLTTHVPKCRLKLNAARRRRYNRPQLFFSEHHHDRDRTRQRRRTPAAVQPPHPLGRNRHRRAAEAFRRAYFGRRLRRIGRRRPCPISPPRGSAR

SEQ ID NO: 1220 - protein, 575 aa, Neisseria
  VARIANT (1)...(575): Xaa = Any Amino Acid
MVAVCDKRAVQRTLMAQFAQQGGLFLLFVQAVVVFQACVLEKLGNHIGVFACVLAQVERHHVKAEHGYGTDEVCQTAFGKQTAAVVDKGTLQFFQIIQKLLCRSIRLEKAEFAAHTQTERARFAHSARHNVGDGAAVGFFGAGDFFVGRFVGQRRYIAVDFDAADGERQFAVEFVEFAAIEAEHGIGVAAEGKAQGFGRNKRIAVAVAADPAADFEDVRNADAGIGRLKVVFHLAVELGQGFEKAHREDGHAVVDFVVDAEFVAARFAGLPQAQQDSVDFAAQPCQRVGIGAAFALRQQCADAAVEAXDGLALHFGRVRGQNGGNGRIVQLPLHRFAVGFPRFEPADGFRQAAFRAAASGFFVDLAAAFVVHVFGDVQNLGEQAAGQGXIVGLLFVQLRQYFFNQCRAVVGSGQEFDCFDNQRRGFFVQEVEQGLFQKFRVRRQSRVLWIVQNMQLHDFSLSSAVNIVNVPQMPHPCQTVHTLTARVPKCRLKLNAARRQRYNRPQLFFSEHHHDHDRTRQRRCIPAAVQPPHPLGRNRHRRAAETFRRAYFGRRLRRFGCRRTXPTLPLRVSAR

SEQ ID NO: 1221 - protein, 573 aa, Neisseria
  VARIANT (1)...(573): Xaa = Any Amino Acid
MVAVCDERTVQWTLMAQFAQQGGLFLLFVEAVVVFQACVLEKLGNHIGVFACVLAQVERHHVEAEHGYGTDEVCQTAFGKQAAAVVDKGMLQFFQIIEKFLCRSIRLEKAEFAAHTQTERARFAHSARHNVGNGATVGFFGAGGFFVGRFVGQRHHIAVDFDAADGERQFAVEFVEFATVKTEHGIGVAAEGKTQGFGRNERIAVAVAADPAADFEDVRNADIGIGRLKVVFHLAVELGQGFKKAHRKDGHAVVDFVVDAEFVAARFAGLPQAQQDSVDFAAQPCQRVGIGTAFALRQQRADAAVEIQDGLALHFGRVRGQNGGNGRIVQLPLHRFAVGFPRFEPADGFRQAAFRAAASGFFVDLAAAFVVHVFGDVQNLGEQAAGQGIVGLLFVQLRQYFFNQCRAVVGSGQEFDRFDNQRRGFFVQEVEQGLFQKFRVRRQSRVLWIVQNMQLHDFSLIAVNTVNVPQMPHPCQTVHTLTARVPKCRLKLNAARRQRYNRPQLFXSEHHHDHDRTRQRRCIPAAVQPPHPLGRNWHRRAAETFRRAYFGRRLRRFGCRXPCPISPLPASAR

SEQ ID NO: 1222 - protein, 132 aa, Neisseria
MPSRTPQGKRGYSCPKRDSAFWQALSISVILRAKSPIAKSPPFREVFNRSWTTLSAAIMTIFSLSATRPPSRMASALPLSIPTACNSVSFSSAGVLTVSRGVHDFDVDLFDVHPLILIAAFPAVGGGALPVR

SEQ ID NO: 1223 - protein, 132 aa, Neisseria
  VARIANT (1)...(132): Xaa = Any Amino Acid
MPSRTPQGKRGYSCAKRDSAFWQALSISAILRAKSPIAKSPPFREVFNRSWTTLSAAIMTIFSLSATRPPSRMASALPLSIPTACNSVSFSSAGVLTVSRGVXDFXVDLFDVHPLILIAAFPAIGGGALPVR

SEQ ID NO: 1224 - protein, 132 aa, Neisseria
  VARIANT (1)...(132): Xaa = Any Amino Acid
MPSRTPQGKRGYSCAKRDSAFWQALSISAILRAKSPIAKSPPFREVFNRSWTTLSAAIMTIFSLSATRPPSRMASALPLSIPTACNSVSFSSAGVLTVSRXVHDFDVDLFDVHPLILIAAFPAVGGGALPVR

SEQ ID NO: 1225 - protein, 277 aa, Neisseria
MKVLVLGAGVAGVSSVWYLAEAGHEVTVIDRTEGVAMETSFANAGQLSYGYTTPWAAPGIPTKALKRLFKSHPPLLFRPDGGLYQIEWLWRMLQNCTATRYQINKERMVRISEYSREMFRRFEAQTDMNFEGRKKGTLQIFRQTEEVEAAKQDIAVLERYGVPYRRLKPEECAEFEPALARVTAKIVGGLHLPADATGDCRLFTENLYKLCQEKGVRFYFNQTISRIDHNGLRIKAVETKQGGLKQMPLSARSAASAGLCWRSWISICPFIPSKAIP

SEQ ID NO: 1226 - protein, 122 aa, Neisseria
VLERYGVPYRRLKPEECAEFEPALARVTAKIAGGLHLPADATGDWRLFTENLYKLCQEKGVRFHFNQNISRIDHNGLRIKTVETKQGGLKQMPLSARSVASAGRFWRSWISICPFIPSKAIP

SEQ ID NO: 1227 - protein, 277 aa, Neisseria
MKVLVLGAGVAGVSSAWYLAEAGHEVTVIDRAEGVAMETSFANAGQLSYGYTTPWAAPGIPTKALKWLFKSHPPLLFRPDGSLYQIEWLWQMLQHCTAARYQINKERMVRMSEYSREMFRRFEAQTGMNFEGRKKGTLQIFRQTKEVEAAKQDIAVLERYGVPYRRLKPEECAEFEPALARVTAKIAGGLHLPADATGDCRLFTENLYKLCQEKGVRFHFNQTISRIDHNGLRIKTVETKQGGLKQMPLSARSAASAGRFWRKWISICRFIPSKAIP

SEQ ID NO: 1228 - protein, 191 aa, Neisseria
MGSAPNAAAAAEVKHPVSQGMIQMLGVFVDTIIVCSCTAFIILIYQQPYGDLSGAALTQAAIVSQVGQWGAGFLAVILFMFAFSTVIGNYAYAESNVQFIKSHWLITAVFRMLVLAWVYFGAVANVPLVWDMADMAMGIMAWINLVAILLLSPLAFMLLRDYTAKLKMGKDPEFKLSEHPGLKRRIKSDVW

SEQ ID NO: 1229 - protein, 191 aa, Neisseria; identical to SEQ ID NO: 1228

SEQ ID NO: 1230 - protein, 475 aa, Neisseria
  VARIANT (1)...(475): Xaa = Any Amino Acid
MNENFTEWLHGWVGAINDPMWSYLVYXLLGTGLFFTVTTGFVQFRLFGRSIKEMLGGRKQGDDPHGITPFQAFVTGLASRVGVGNIAGVAIAIKVGGPGAVFWMWVTALIGMSSAFVESSLAQLFKVRDYDNHHFRGGPAYYITQGLGQKWLGVLFALSLIFCFGFVFEAVQTNTIADTVKAAWGWEPHYVGVALVILTAPIIFGGIRRISKAAEIVVPLMAVLYLFIALFIILTNIPMIPDVFGQIFSGAFKFDAAAGGLLGGLISQTMMMGIKRGLYSNEAGMGSAPNAAAAAEVKHPVSQGMIQMLGVFVDTIIVCSCTAFIILIYQQPYGDLSGAALTQAAIVSQVGQWGAGFLAVILFMFAFSTVIGNYAYAESNVQFIKSHWLITAVFRMLVLAWVYFGAVANVPLVWDMADMAMGIMAWINLVAILLLSPLAFMLLRDYTAKLKMGKDPEFKLSEHPGLKRRIKSDVW

SEQ ID NO: 1231 - protein, 359 aa, Neisseria
MVQIQVVRAAGVARGLHSEFARAVTAEEIAFDNAVLNHEARRGGNTFRIKIAAAERAGDVRFFAQVEEIGQDFFADAVDQETALAVERAAGECADEVSDQPARNGGIEEDGVAACRDAAAAESAQSAAGGGLTDGFGAVHIRMAAGGIVPVVALHSVFVGGDDAAGNAVVRALPVCGKTVGVAVNVLVLSGLHRRAFGVFDAAVRVQRCLFALFCQADGGFRIQIPFVVKVGVADVLRHQLGVGKSGATVFGGVAGDVGGGADGVAQGLFGEVGGAGAAFAFADVNGNVQRFVLLELDLFDFAQAHADALSERFAEVGFGGGRARCFCQVERAAAEVEEFGSGVVEQHNNLSWWSVVAF

SEQ ID NO: 1232 - protein, 305 aa, Neisseria
  VARIANT (1)...(305): Xaa = Any Amino Acid
GKSGGCAFFAQVEEIGQDFSADAVDQETALAVERAAGECADEVSDKTARNGGIEEDGVAACRDAAAAESAQSAAGGGLTDGFGAVHIRMAAGGIVPVVALHAVFVGGNDAAGNAVVRALPVCGKTVGVAVNVLVMAGLHRRAFGVFDALILVQGGLFALFCQADGGXRIQIPFVVKVGVADVFCHQTGIGKSGATVFGGVAGDVDGGFDGVLQGFFGEVGSTGAAFAFADVNGNVQRLVLLELDLXDXAQPHADALSQXFAEIGFGGGCARRFCQVERAAAEVEEFGSGVVEQHRNLSXXCFAAF

SEQ ID NO: 1233 - protein, 356 aa, Neisseria
  VARIANT (1)...(356): Xaa = Any Amino Acid
MVQIKVVRAAGVARGLHSEFARAVTAEEIAFDNAVLNHEARCGGNAFRIKIAAAERAGDVRFFAQVEEIGQDFFADAVDQETALAVERSAGECADEVSDKTARNGGIEEDGVVACRDAAAAESAQSAAGGGLTDGFGAVHIRMAAGGIVPVVALHAVFVGGNDAAGNAVVRALPVCGKTVGVAVNVLVMAGLHRRAFGVFDALILVQGGLFALFCQADGGFRIQIPFVVKVGVADVLRHQLGVGKSGATVFGGVAGDVXXGADGVAQGLFGEIGGAGAAFAFADVNGNVQRLVLLKLDLFDFAQPHADALSQFAEIGFGGGCARRFCQVERAAAEVEEFGSGVVEQHRNLSCFAAF

SEQ ID NO: 1234 - protein, 359 aa, Neisseria
MVQIQVVRAAGVARGLHSEFARAVTAEEIAFDNAVLNHEARRGGNTFRIKIAAAERAGDVRFFAQVEEIGQDFFADAVDQETALAVERAAGECADEVSDQPARNGGIEEDGVAACRDAAAAESAQSAAGGGLTDGFGAVHIRMAAGGIVPVVALHSVFVGGNDAAGNAVVRALPVCGKTVGVAVNVLVVSGLHRRAFGVFDAAVRVQRCLFALFCQADGGFRIQIPFVVKVGVADVLRHQLGVGKSGATVFGGVAGDVGGGADGVAQGLFGEVGGAGAAFAFADVNGNVQRFVLLELDLFDFAQAHADALSERFAEVGFGGGRARCFCQVERAAAEVEEFGSGVVEQHNNLSWWSVVAF

SEQ ID NO: 1235 - protein, 312 aa, Neisseria
MVQIQVVRAAGVARGLHTEFARAVTAEEIAFDNAVLNHEARCGGNAFRIKIAAAERAGDVRFFAQVEEIGQDFFADAVDQETALAVERAAGECADEVSDKTARNGGIEEDGVAACRDAAAAESAQSAAGGGLTDGFGAVHIRMAAGGIVPVVALHAVFVGGNDAAGNAVVRALPVCGKTVGVAVNVLVMAGLHRRAFGVFDALILVQGGLFALFCQADGGFRIQIPFVVKVGVADVFCHQTGIGKSGATVFGGVAGDVDGGFDGVLQGFFGEVGSTGAAFAFADVNGNVQRLVLLELDLFDFAQPHADALSQ

SEQ ID NO: 1236 - protein, 312 aa, Neisseria
MVQIKVVRAAGVARGLHSEFARAVTAEEIAFDNAVLNHEARCGGNAFRIKIAAAERAGDVRFFAQVEEIGQDFFADAVDQETALAVERSAGECADEVSDKTARNGGIEEDGVVACRDAAAAESAQSAAGGGLTDGFGAVHIRMAAGGIVPVVALHAVFVGGNDAAGNAVVRALPVCGKTVGVAVNVLVMAGLHRRAFGVFDALILVQGGLFALFCQADGGFRIQIPFVVKVGVADVLRHQLGVGKSGATVFGGVAGDVGGGADGVAQGLFGEIGGAGAAFAFADVNGNVQRLVLLKLDLFDFAQPHADALSQ

SEQ ID NO: 1237 - protein, 237 aa, Neisseria; identical to SEQ ID NO: 112

SEQ ID NO: 1238 - protein, 238 aa, Neisseria; identical to SEQ ID NO: 110

SEQ ID NO: 1239 - protein, 237 aa, Neisseria; identical to SEQ ID NO: 111

SEQ ID NO: 1240 - protein, 167 aa, Neisseria
MHRVSDGIGVSVVFCRFVGFDDFLHQRMPDNVFAGEGMEIQSCHAVQFLTCVFQSRFDVFGQVDLAGVAGNDGFRAEADAGQEHFHLFGRGVLRFVEDDVCAVERPAAHIGERGDFNQAFFNQLGYTVKAHQVIEGIIKRTEVGVDFLGQVSGQEAQFLTGFDGRPN

SEQ ID NO: 1241 - protein, 167 aa, Neisseria
  VARIANT (1)...(167): Xaa = Any Amino Acid
MHRVSDGIGMSVVFCRFVGFDDFLHQRMPDNVFAGKGVEIQPFHVVQFLTRIFXSRFDVFGQVDLAGVAGNDGFRAEADAGQEHFHLFGRGVLRFVEDDVCAVERPAAHIGERGDFNQAFFNQLGYTVKAHQVIEGIIKRTKVGIDFLGQVSGQEAQFLAGFDGWAH

SEQ ID NO: 1242 - protein, 166 aa, Neisseria
MHRVSDGIGMSVVFCRFVGFDDFLHQRMPDNVFAGKGVEIQPFHAVQFLTRIFSRFDVFGQVDLAGVAGNDGFRAEADAGQEHFHLFGRGVLRFVEDDVCAVERPAAHIGERGNLNQTFFNQLGDTVEAHQVIEGIIKRTKVGIDFLGQVTGQKTQFLAGFDGRPH

SEQ ID NO: 1243 - protein, 115 aa, Neisseria
MTFSAAKLNISALMLCLSAGMTVLLSAFLLLRPEGSILFNHFFSINILTRRAASPRATVFRLHQAVRFHKMPKTISKMRRNYAVRITPPPRAATLHYNRLPLKKSDPAFVAESEI

SEQ ID NO: 1244 - protein, 133 aa, Neisseria
  VARIANT (1)...(133): Xaa = Any Amino Acid
MTFSAAKLNISARMLCLSAGMTVLLSAFLLLRPEGSILFNHFFSINILTRRAASPQATVFRRHQARFARCRTINKRRRNYAVRITPPSXAATRHYNRLPSAAGLVRRERRRCAVILSNGRKKSDPAFVAESEI

SEQ ID NO: 1245 - protein, 114 aa, Neisseria
  VARIANT (1)...(114): Xaa = Any Amino Acid
MTFSAAKLNISARMLCLSAGMTVLLSAFLLLRPEGSILFNHFFSINILTRRAASPRATVFRRHQAVRFRKMPTINKRRRNYAVRITPSSXAATRHYNRLPSKKSDPAFVAESEI

SEQ ID NO: 1246 - protein, 316 aa, Neisseria
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRAMQAQITAEREKRARIAESEGRKIEQINLASGQREAEIQQSEGEAQAAVNASNAEKIARINRAKGEAESLRLVAEANAEANRQIAAALQTQSGADAVNLKIAGQYVTAFKNLAKEDNTRIKPAKVAEIGNPNFRRHEKFSPEAKTAK

SEQ ID NO: 1247 - protein, 199 aa, Neisseria
SVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 1248 - protein, 315 aa, Neisseria
MEFFIILLAAVVVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 1249 - protein, 315 aa, Neisseria
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRAMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 1250 - protein, 315 aa, Neisseria
MEFFIILLVAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 1251 - protein, 315 aa, Neisseria; identical to SEQ ID NO: 1248

SEQ ID NO: 1252 - protein, 197 aa, Neisseria
MPALLSIRRANALPFSRISERMKLLVPLIMPAMDLILFAAKPSRTALMIGIPPATAASNWTMTFCFSASGKISLPYSASSFLLAVTMCLPFSMAFNTASLAMPVPPNNSTKTSTSLRANSSNGSFDKGGRRADFGGLFLRLSRTWQKYGFRAPSGGKFPLRCPATRQPHRRRPYLSLKDRCLLASLCLLVSRLKCKY

SEQ ID NO: 1253 - protein, 197 aa, Neisseria
  VARIANT (1)...(197): Xaa = Any Amino Acid
MPALLSVHXANALPFSRISXRMKLLVPLIMPAMDLILFAAKPSRRALMIGIPPATAASNWTMTFCFSASGKISLPYSASSFLLAVTMCLPFSMAFNTASLAMPVPPNNSTTTSTSSRATSSNGSLTKAXRTGRFVGLFLHSNRTRQKYGFRAPSDGKFPPRCXATRQPYRRRPYPNLKDRCLLASLCLLVSRLKCKY

SEQ ID NO: 1254 - protein, 197 aa, Neisseria
  VARIANT (1)...(197): Xaa = Any Amino Acid
MPALLSVHRXNALPFSRISERMKLLVPLIMPAMDLILFAAKPSRRALMIGIPPATAASNWTMTFCFSASGKISLPYSASSFLLAVTMCLPFSMAFNTASLAMPVPPNNSTTTSTSSRATSSNGSLTKAXRTGRFVGLFLHSNRTRQKYGFRAPSDGKFPPRCPATRQPYRRRPYPNLKDRCLLASLCLLVSRLKCKY

SEQ ID NO: 1255 - protein, 173 aa, Neisseria
MKLLVPLIMPAMDLILFAAKPSRRALMIGIPPATAASNWTMTFCFSASGKISLPYSASSFLLAVTMCLPFSMAFNTASLAMPVPPNNSTTTSTSLRATSSNGSLTKAADGQIWRAFSSLKSHMAEIRISRPKRREISSALSRNTAAAPPPTVPKPKRPMFTGFIVSPCKPTEM

SEQ ID NO: 1256 - protein, 173 aa, Neisseria
MKLLVPLIMPAMDLILFAAKPSRRALMIGIPPATAASNWTMTFCFSASGKISLPYSASSFLLAVTMCLPFSMAFNTASLAMPVPPNNSTTTSTSSRATSSNGSLTKAADGQVCRAFSSLKSHTAEIRISRPKRREISSALSRNTAAVPPPTVPKPKRPMFTGFIVSPCKPTEM

SEQ ID NO: 1257 - protein, 173 aa, Neisseria; identical to SEQ ID NO: 1256

SEQ ID NO: 1258 - protein, 169 aa, Neisseria
MKSKLPLILINLSLISSPLGANAAKIYTCTINGETVYTTKPSKSCHSTDLPPIGNYSSERYILPQTPEPAPSPSNGGQAVKYKAPVKTVSKPAKSNTPPQQAPVNNSRRSILEAELSNERKALTEAQKMLSQARLAKGGNINHQKINALSNVLDRQQNIQALQRELGRM

SEQ ID NO: 1259 - protein, 171 aa, Neisseria
  VARIANT (1)...(171): Xaa = Any Amino Acid
MKSKLLLILINFSLISSPLGANAAKIXTCTINGETVYTXKPSKSCHSTDLPPIGNYSSERYIPPQTPEPVSSPSNGGXVVKYKAPVKTVSKPAKSXTPPPQQAPSNNSRRSILETELSNERKALVEAQKMLSQARLAKGGNINHQEINALQSNVLDRQQNIQALQRELGRM

SEQ ID NO: 1260 - protein, 170 aa, Neisseria
MKSKLPLILINFSLISSPLGANAAKIYTCTINGETVYTTKPSKSCLSTDLPPIGNYSSERYIPPQTSEPTPSPSNGGQAVKYKAPVKTVSKPAKSNTPPPQQAPSNNSRRSILETELSNERKALVEAQKMLSQARLAKGGNINHQEINALQSVLDRQQNIQALQRELGRM

SEQ ID NO: 1261 - protein, 144 aa, Neisseria
MTEPKHETPTEEQVAARKKAKAKIRTIRIWAWVILALLASTALLSQCAMSKPQAKQKIVESCMKNIPFAEKWQNDLKARGLDADNTRLAVDYCKCMWEQPLDGLSEKQISSFGKLGAQEQLDLLGGANAFETRDKQCVADLKAD

SEQ ID NO: 1262 - protein, 144 aa, Neisseria
MTEPKHEMLTKEQVAARKKAKAKIRTIRIWAWVILALLALTALLSQCAMSKPQAKQKIVESCVKNIPFAEKWQNDLRARGLDSNNTRLAVDYCKCMWEQPLDRLSEKQIRSFGKLGAQEQLDLLGGANAFEARDKQCVADLKSE

SEQ ID NO: 1263 - protein, 144 aa, Neisseria
MTEPKHEMPTEEQVAARKKAKAKIRTIRIWAWVILALLASTALLSQCAMSKPQAKQKIVESCVKNIPFAEKWQNDLRARGLDSNNTRLTVDYCKCMWEQPLDRLSEKQISSFGKLGAQEQLDLLGGANAFETRDKQCVADLKSE

SEQ ID NO: 1264 - protein, 135 aa, Neisseria; identical to SEQ ID NO: 64

SEQ ID NO: 1265 - protein, 126 aa, Neisseria; identical to SEQ ID NO: 62
  VARIANT (1)...(126): Xaa = Any Amino Acid

SEQ ID NO: 1266 - protein, 135 aa, Neisseria; identical to SEQ ID NO: 63

SEQ ID NO: 1267 - protein, 186 aa, Neisseria
MKYVRLFFLGTALAGTQAAAAEMVQIEGGSYRPLYLKKDTGLIKVKPFKLDKYPVTNAEFAEFVNSHPQWQKGRIGSKQAEPAYLKHWMKNGSRSYAPKAGELKQPVTNISWFAANAYCAAQGKRLPTIDEWEFAGLASATQKKRLKRTRLQPHYSRLVCRRRTERPARCRQSTARTTGVFMICTG

SEQ ID NO: 1268 - protein, 186 aa, Neisseria
  VARIANT (1)...(186): Xaa = Any Amino Acid
MKYVRLFXLGAALAXTQXAAAEMVQIEGGSYRPLYLKKDTGLIKVKPFKLDKYPVTNAEFAEFVNSHPQWQKGRIGSKQAEPAYLKHWMKNGSRSYAPKAGELKQPVTNVSWXAANAYCAAQGKRLPTIDEWEFAGLASATQKXRLKRTRLQPHYSRLVCRRRTERPARCRXKAARTTGAFMICTG

SEQ ID NO: 1269 - protein, 186 aa, Neisseria
  VARIANT (1)...(186): Xaa = Any Amino Acid
MKFTRLLFLCAALAGTQAAAAEMVQIEGGSYRPLYLKKDTGLIKVKPFKLDKYPVTNAEFAEFVNSHPQWQKGRIGSKQAEPAYLKHWMKNGSRSYAPKAGDLKQPVTNVSWFAANAYCAAQGKRLPTIDEWEFAGLASATQXKRLKRTRLQPHYSRLVCGWRPERPARCRQXVARTTGAFMICTV

SEQ ID NO: 1270 - protein, 251 aa, Neisseria
MKYVRLFFLGTALAGTQAAAAEMVQIEGGSYRPLYLKKDTGLIKVKPFKLDKYPVTNAEFAEFVNSHPQWQKGRIGSKQAEPAYLKHWMKNGSRSYAPKAGELKQPVTNISWFAANAYCAAQGKRLPTIDEWEFAGLASATQKNGSNEPGYNRTILDWYADGGRKGLHDVGKDRPNYWGVYDMHGLIWEWTEDFNSSLLSSGNANAQMFCSGASVGASDSSNYAAFLRYGIRTSLQSKYVLHNLGFRCASR

SEQ ID NO: 1271 - protein, 251 aa, Neisseria
MKYVRLFFLGAALAGTQAAAAEMVQIEGGSYRPLYLKKDTGLIKVKPFKLDKYPVTNAEFAEFVNSHPQWQKGRIGSKQAEPAYLKHWMKNGSRSYAPKAGELKQPVTNVSWFAANAYCAAQGKRLPTIDEWEFAGLASATQKNGSNEPGYNRTILDWYADGGRKGLHDVGKGRPNYWGVYDMHGLIWEWTEDFNSSLLSSGNANAQMFCSGASIGSSDSSNYAAFLRYGIRTSLQSKYVLHNLGFRCTSR

SEQ ID NO: 1272 - protein, 251 aa, Neisseria
MKFTRLLFLCAALAGTQAAAAEMVQIEGGSYRPLYLKKDTGLIKVKPFKLDKYPVTNAEFAEFVNSHPQWQKGRIGSKQAEPAYLKHWMKNGSRSYAPKAGDLKQPVTNVSWFAANAYCAAQGKRLPTIDEWEFAGLASATQKNGSNEPGYNRTILDWYADGDRKDLHDVGKGRPNYWGVYDMHGLIWEWTEDFNSSLLSSGNANAQMFCSGASIGSSDSSNYAAFLRYGIRTSLQSKYVLHNLGFRCTSR

SEQ ID NO: 1273 - protein, 150 aa, Neisseria
MVLPVSFFQPVQLAAVALGRSAVGMGGSDAAELVELFALFPQCCRFRVFFIQKPRLGCRAALVVQTFNLDFMGKGIERQVDNIADVYGFTVFDFRAVYLNPTQFDMLLRKGTGLEKTCRPKPFVQPHGGRIVLVFHTILFEIIEFVSSLA

SEQ ID NO: 1274 - protein, 150 aa, Neisseria
  VARIANT (1)...(150): Xaa = Any Amino Acid
MVLPVSFFQPVQLAAVALGRSAVGIGGSDAAELVELFALFPQCCRXRVLFIQKPRXGCRAALVVQTFNXDFIGKXNXASVXXIADVYGFTVFDLRAVYLNPTQFDVLLRKGTGLEKTCRPKPFVQPHGGRIVLVFHTILFEIIEFVSSLA

SEQ ID NO: 1275 - protein, 150 aa, Neisseria
MVLPVSFFQPVQLAAVALGRSAVGIGGSDAAELVELFALFPQCCRFRVLFIQKPRLGCRAALVVQTFNLDFIGKGIERQVDNIADVYGFTVFDLRAVYLNPTQFDVLLRKGTGLEKTCRPKPFVQPHGGRIVLVFHTILFEIIEFVSSLA

SEQ ID NO: 1276 - protein, 135 aa, Neisseria; identical to SEQ ID NO: 462

SEQ ID NO: 1277 - protein, 121 aa, Neisseria; identical to SEQ ID NO: 459
  VARIANT (1)...(121): Xaa = Any Amino Acid

SEQ ID NO: 1278 - protein, 135 aa, Neisseria; identical to SEQ ID NO: 461

SEQ ID NO: 1279 - protein, 135 aa, Neisseria; identical to SEQ ID NO: 463

SEQ ID NO: 1280 - protein, 135 aa, Neisseria; identical to SEQ ID NO: 460

SEQ ID NO: 1281 - protein, 135 aa, Neisseria; identical to SEQ ID NO: 461

SEQ ID NO: 1282 - protein, 119 aa, Neisseria
MTHIKPVIAALALIGLAACSGSKTEQPKLDYQSRSHRLIKLEVPPDLNNPDQGNLYRLPAGSGAVRAGDLEKRRTPAVQQPADAGSIEKRQRRPLRAATAANAWLVVDGKSPAEISAAF

SEQ ID NO: 1283 - protein, 375 aa, Neisseria
MTHIKPVIAALALIGLAACSGSKTEQPKLDYQSRSHRLIKLEVPPDLNNPDQGNLYRLPAGSGAVRASDLEKRRTPAVQQPADAEVLKSVKGVRLERDGSQRWLVVDGKSPAEIWPLLKAFWQENGFDIKSEEPAIGQMETEWAENRAKIPQDSLRRLFDKVGLGGIYSTGERDKFIVRIEQGKNGVSDIFFAHKAMKEVYGGKDKDTTVWQPSPSDPNLEAAFLTRFMQYLGVDGQQAENASAKKPTLPAANEMARIEGKSLIVFGDYGRNWRRTVLALDRIGLTVVGQNTERHAFLVQKAPNESNAVTEQKPGLFKRLLGKGKAEKPAEQPELIVYAEPVANGSRIVLLNKDGSAYAGKDASALLGKLHSELR

SEQ ID NO: 1284 - protein, 375 aa, Neisseria
MTHIKPVIAALALIGLAACSGSKTEQPKLDYQSRSHRLIKLEVPPDLNNPDQGNLYRLPAGSGAVRASDLEKRRTPAVQQPADAEVLKSVKGVRLERDGSQRWLVVDGKSHAEIWPLLKAFWQENGFDIKSEEPAIGQMETEWAENRAKIPQDSLRRLFDTVGLGGIYSTGERDKFIVRIEQGKNGVSDIFFAHKAMKEVYGGKDKDTTVWQPSPSDPNLEAAFLTRFMQYLGVDGQQAENASAKKPTLPAANEMARIEGKSLIVFGDYGRNWRRTALALDRIGLTVVGQNTERHAFLVQKAPNESNAVTEQKPGLFKRLLGKGKAEKPAEQPELIVYAEPVANGSRIVLLNKDGSAYAGKDASALLGKLHSELR

SEQ ID NO: 1285 - protein, 99 aa, Neisseria
MSASAAMTGLIWVIVSSCVMDIKVFVMLCRPNGSDGMAIFKVVLRLSGRRGLLPVRLPSAERAAGARAVRIRPRRIPPISVRRDWVRRTWCRKSESAGR

SEQ ID NO: 1286 - protein, 99 aa, Neisseria
  VARIANT (1)...(99): Xaa = Any Amino Acid
XSASAAMTGLIWVIVSSCVMDIKVXVAXCRPNGSDGMXIFKVVLRLSGRRGLLXVRFPSAERAAGGRAVRICPGRIPPISVRRGWVRRTWCRKSESVGR

SEQ ID NO: 1287 - protein, 99 aa, Neisseria
MSASAAMTGLIWVIVSSCVMDIKVFVALCRPNGSDGMAIFKVVLRLSGRRGLLPVRLPSAERAAGGRAVRICPGRIPPISVRRGWVRRTWCRKSESAGR

SEQ ID NO: 1288 - protein, 162 aa, Neisseria
MTALLVILALALIAVGTAGIVYPALPGLALMFAGTWLLAYAGGYQIYGAGILWTVGLISLGGILADYMAGMLGVKYTGAGKLAVRGALAGSIIGIFFSLPGLILGPFIGAAAGELIDRRNMLQAGKAGLGTLLGLVVGTAFKIGCAVSILFILLVKYIAYLF

SEQ ID NO: 1289 - protein, 162 aa, Neisseria
MTVLTVILALALIAVGTAGIVYPALPGLALMFAGTWLLAYAGGYQIYGAGVLWTVGLISLAGILADYVAGIWGTKYTGAGKLAVRGALAGSIIGIFFSLPGLILGPFIGAAAGELIERRNMLQAGKAGLGTLLGLVVGTAFKIGCAVSILFILLVKYIAYLF

SEQ ID NO: 1290 - protein, 162 aa, Neisseria
MTALLVILALALIAAGTAGIVYPALPGLALMFAGTWLLAYSGGYQIYGAGVLWTVGLISLAGILADYVAGIWGTKYTGAGKLAVRGALAGSIIGIFFSLPGLILGPFIGAAAGELIERRNMLQAGKAGLGTLLGLIVGTAFKIGCAVSILFILLVKYIAYLF

SEQ ID NO: 1291 - protein, 110 aa, Neisseria
MAETMKKQADSPDLVYGLEDRPPFGNALLSAVTHLLAIFVPMITPALIVGGALELPVEMTAYLVSMAMVASGVGTYLQVNRFGSVGSGMLSIQRYRHDCARRGDERGRFE

SEQ ID NO: 1292 - protein, 463 aa, Neisseria
MSGQLGKGADAPDLVYGLEDRPPFGNALLSAVTHLLAIFVPMITPALIVGGALELPVEMTAYLVSMAMVASGVGTYLQVNRFGPVGSGMLSIQSVNFSFVTVMIALGAGMKEGGLTKDAMISTLLGVSFVGAFLVCFSAWLLPYLKKVITPTVSGVVVMLIGLSLVHVGITDFGGGFGAKADGTFGSMENLGLASLVLLIVLVFNCMKNPLLRMSGIAVGLIAGYIVALFLGKVDFSALQNLPLVTLPVPFKYGFAFDWHAFIVAGAIFLLSVFEAVGDLTATAMVSDQPIEGEEYTKRLRGGVLADGLVSVIATALGSLPLTTFAQNNGVIQMTGVASRHVGKYIAVILVLLGLFPVVGRAFTTIPSPVLGGAMVLMFGLIAIAGVRILVSHGIRRREAVIAATSVGLGLGVAFEPEVFKNLPVLFQNSISAGGITAVLLNLVLPEDKTEAAVKFDTDHLEH

SEQ ID NO: 1293 - protein, 463 aa, Neisseria; identical to SEQ ID NO: 1292

SEQ ID NO: 1294 - protein, 262 aa, Neisseria
  VARIANT (1)...(262): Xaa = Any Amino Acid
MPFPVFRQXFAXSLLRFFAVGRILESDISNSGFSETINASNVFFVGYEYPACISNLHRFQFRKLGIQFFHALFAEVDGQSGGFAFVCGIDNHAGAEFGVTDVLSDAEACVGLRLFEVIDDFVPLYGGLARVAVAVEGGFFDGQVVQYFWRDFFDEAGCDAELGLSVQHALLCHGDVEAFAGAGDGDVHEAAFFFEAAALGKAHFAGETPLFHTGEEDGVEFQAFGGVDGHQLDGFFACPCLVFAGFEGGVAQEGEDGEGGIV

SEQ ID NO: 1295 - protein, 261 aa, Neisseria
  VARIANT (1)...(261): Xaa = Any Amino Acid
MPFPVFRRPFALSLLTFFAVSQILVSDISNSGVSETIDASNVFVGYEYPTYISNLHLFQFRKLGVQLFHALFAEIDGQSGGFAFICGIDNHAGAEFGVADVLSDTETCVGLGLFVVVDDFIFGCGGLARVAVTVVGRLFDGQVVQYFGWDLFDEAGDDAELGLSVQHALLRHGDVEAFAGAGDGDVHEAAFFFEAAAFGKAHFAGEAAFFHAGEEDGVKFQAFGGVDGHELDGLFACACLVFTGFEGGIAXEGENGEGGVV

SEQ ID NO: 1296 - protein, 255 aa, Neisseria
FRRPFALSLLQFFAIGRILESDISNSGFSETIDASNIFVGYEYPACISNLHRFQFRKLGVQLFHALFAEIDGQSGGFAFICGIDNHAGAEFGVADVLSDTETCVGLGLFVVVDDFVFGRGGLARVAIAVVGGFFDGQVVQYFGRDFFDEAGDDAELGLSVQHALLRHGDVEAFAGAGDGDVHQAAFFFEAAAFGKAHFAGEAAFFHAGEEYGVKFQAFGGVHGHELYGFFARACLVFAGFESSIAESEDGEGGVV

SEQ ID NO: 1297 - protein, 426 aa, Neisseria
MKSLFIWLLLLGSAAGVFYHTQNQSLPAGELVYPSAPQIRDGGDALHYLNRIRTQIGLHALAHAPVLENSARRHARYLTLNPEDGHGEHHPDNPHYTAQKLTERTRLAGYLYNGVHENISTEEEAAESSDSDIRTQQRQVDALMSAIYHRLSLLDRHTDEAGAAFVRENGKTVLVFNQGNGSFERACAKGRRQPEAGRKYYRNACHNGAAVYADEAMPVTELLYTAYPVGGGALPYFYGERPDPVPEYEITGNPASIDFSEAAGKIAMKSFKLYQGKNEIRPVRVLTAGNDPNGRLTAHQFALFPLKPLEYGTLYTAVFDYVRNGRHAQAKWQFRTRKPDYPYFEVNGGETLAVRKGEKYFIHWRGRWCLEACTRYTYRRQFGNSLSILRHEAGGIVFSVSGMAGSRIRLTPEDSPERGVTLYLQD

SEQ ID NO: 1298 - protein, 164 aa, Neisseria
  VARIANT (1)...(164): Xaa = Any Amino Acid
MKSLFIRLLLLGSAAGVFYHTQXQSLPAGELVYPSAPQIRDGGDALHYLNRIRAQIGLHKLAHAPVLENSARRHASYLTLNPEDGHGEHHPDNPHYTAQKLTERTRLAGYLYNGVHENISTEEEAAESSDSDIRTQQRQVDGLMSAIYHRLSLLDRHTDESGAA

SEQ ID NO: 1299 - protein, 426 aa, Neisseria
MKSLFIRLLLLGSAAGVFYHTQNQSLPAGELVYPSAPQIRDGGDALHYLNRIRAQIGLHKLAHAPVLENSARRHARYLTLNPEDGHGEHHPDNPHYTAQKLTERTRLAGYLYNGVHENISTEEEAAESSDSDIRTQQRQVDGLMSAIYHRLSLLDRHTDEAGAAFVRENGKTVLVFNQGNGRFERHCAQGRNQPEAGRKYYRNACHNGAVVYTDEAMPAQELLYTAYPVGNGALPYFHGERPDPVPEYEITGNPASIDFSEAAGKITMKSFKLYQGKNEIRPVRVLTAGNDPNGRLTAYQFALFPLKPLEYGTLYTAVFDYVRNGRRAQAKWQFRTRKPDYPYFEVNGGETLAVRKGEKYFIHWRGRWCLEACTRYTYRQRPGSRLSIGRHKAGGIVFSVDGMAGSRITLAPEGETERGVTLYLQD

SEQ ID NO: 1300 - protein, 392 aa, Neisseria
MSGRTGRNSATQAQPERVMLVGVMLDKDDTGSNAARLNGFQTALAEAVELVKAAGGDSVRVETAKRDRPHTALFVGTGKAAELSEAVAADGIDLVVFNHELTPTQERNLEKILQCRVLDRVGLILAIFARRARTQEGRLQVELAQLSHLAGRLIRGYGHLQSQRGGIGMKGPGETKLETDRRLTAHRINALKKQLANLKKQRALRRKSRESGRIKTFALVGYTNVGKSSLFNRLTKSGIYAKDQLFATLDTTARRLYISPACSIILTDTVGFVSDLPHKLISAFSATLEETVQADVLLHVVDAAARNSGQQIEDVENVLQEIHAHDIPCIKVYNKTDLLPSEEQNTGIWRDAAGKIAAVRISVAENTGIDALREAIAEYCAAAPNTDETEMP

SEQ ID NO: 1301 - protein, 379 aa, Neisseria
  VARIANT (1)...(379): Xaa = Any Amino Acid
MTGRTGGNGSTQAQPERVMLVGVMLDKDGTGSSAARLNGFQTALAEAVELVKAAGGDSVRVETAKRDRPHTALFVGTGKAAELSEAVAADGIDLVVFNHELTPTQERNLEKELKCRVLDRVGLILAIFARRARTQEGRLQVELAQLSHLAGRLIRGYGHLQSQRGGIGMKGPGETKLETDRRLIAHRINALIKQLANLKKQRALRRKSRESGTIKTFALVGYTNVGKSSLFNRLTKSGIYAKDKLSPECSIILTDTVGFVSDLPHKLISAFSXTLEETAQADVLLHVVDAAAPNSGQQIEDVENVLQEIHAGDIPCIKVYNKTDLLPSEEQNTGIWRDAAGKIAAVRISVAENTGIDALREAIAESCAAAPNTDETEMP

SEQ ID NO: 1302 - protein, 392 aa, Neisseria
MTGRTGRNGSTQAQPERVMLVGVMLDKDGTGSSATRLNGFQTALAEAVELVKAAGGDSVRVETAKRDRPHTALFVGTGKAAELSEAVAADGIDLVVFNHELTPTQERNLEKILQCRVLDRVGLILAIFARRARTQEGRLQVELAQLSHLAGRLIRGYGHLQSQRGGIGMKGPGETKLETDRRLIAHRINALKKQLANLKKQRALRRKSRESGTIKTFALVGYTNVGKSSLFNRLTKSGIYAKDQLFATLDTTARRLYISPECSIILTDTVGFVSDLPHKLISAFSATLEETAQADVLLHVVDAAAPNSGQQIEDVENVLQEIHAGDIPCIKVYNKTDLLPSEEQNTGIWRDAAGKIAAVRISVAENTGIDALREAIAEYCAAAPNTDETEMP

SEQ ID NO: 1303 - protein, 382 aa, Neisseria; identical to SEQ ID NO: 104

SEQ ID NO: 1304 - protein, 344 aa, Neisseria
  VARIANT (1)...(344): Xaa = Any Amino Acid
MEDLQEIGFDVAAVKVGRQREHHRLHHPQPGNGEADDVLFAFFLVGGFDFLRVIGCGGVAYLPDFQQNVGKADFAVVPDDAAAVRAVIEVDADDAVCTQKLLFDQPDAGGAGDAAEHNRLARAAVGFHKVGLDFGQVVQADLVEDFLGRQLGFLRVGGALFVITAQARVNNALCDRLTAGAQGFAVFVFVTDSQVEVFGNIQTAVETGFFHGISVSSVFGAAAQDSAMASRSASIPVFSATEMRTAAIFPAASRHMPVFCSSDGSRSVLLYTLMHGISPAWISCSTFSTSSICCPLFGAAASTTCSSTSACAVSSSVAXKAEISLCGRSLTNPTVSVRIMLHSG

SEQ ID NO: 1305 - protein, 381 aa, Neisseria; identical to SEQ ID NO: 103

SEQ ID NO: 1306 - protein, 148 aa, Neisseria
MPPSRRGNGVFYQNGKLANAVSACRLPNRQTFPVPVPNPMPSEPSDGIGCLFVHSDGCRFVLCRFVAVIQHAEFDGDASLRFAVGVGIAQGIRAAAVFLLVEVFAFADFNHTRAAAAFAPVEVPIGHIIVRRGGTVSAVVDLRHIFPA

SEQ ID NO: 1307 - protein, 111 aa, Neisseria
PNPMPSEPSDGIGCLFVHPDGGRFVLCRFVAVIQHAEFDGDSALFAVGIGIPQGIGTTAIFLLVEVFTFADFNHARAAAAFAPVEIPIHHIIVRRGGAVSAVVDLRHIFPA

SEQ ID NO: 1308 - protein, 145 aa, Neisseria
MPSSRRGNGVFYQNGKLANAVSDCRLPNRQTFPVPMPNPMPSEPSDGIGCLFVHPDGCRFVLCRFVAVIQHAEFDGDSALFAVGVGIPQGIGTTAIFLLVEFTFADFNHTRAAAAFAPVEIPIHHIIVRRGGAAAAVVNLVHVFP

SEQ ID NO: 1309 - protein, 111 aa, Neisseria
MPKWSRIRRCSVLSLMFSAAVSRLTWCAPPSNAAFRVRLKSSDGIASASAVCPAAGSMPSETVSHKSDSSRNTSASRRNVSPKCPFGTVCRQDAAKPRRFGGKSHILTGSR

SEQ ID NO: 1310 - protein, 121 aa, Neisseria
MPKWSRIRRCSVLSLMFSASVSRLTWCAPSANAAFRVRLKSSDGIASASAVCPAAGPMPSETVSHKSDSSRNTSASRAMFRPNAPLGRNVSPKCPFGTAFRQDAAKPRRFGGKSHILTGSR

SEQ ID NO: 1311 - protein, 110 aa, Neisseria
MPKWSRIRRCSVLSLMFSVSASRLTCAPPANAAFRMRLKSSDGIASASAVCPAAGPMPSETVSHKSDSSRNTSASRRNVSPKCPFGTAFRQDAAKPRRFGGKSHILTGSR

SEQ ID NO: 1312 - protein, 376 aa, Neisseria
MVCRLFAAVFGFQLGNQPVDAFGFDDFAELVAVHGNQARAFDGDVVGTVFAAALVGGKVHIDGLLTGDADFGTDDDFLAALIDDGIVFDVDGRVFEFQHRAGIGADQQGLKFFGQRLFLRVGRGTPRVADRQCGHTLEIEIGNRIGFGFWACRSRVAAFEDGQNLCGVLADLSHCVGRGGKCHADAQNTDAQCADEGGFFHDVFPENGCVCLFCGFFRIAALSVFLGEAGHEFTDQVFQNHCRTGYGDGVAGSKVFRIAALLQPDVLFAQKSRSQDLRGNVTAELILAVQIKAHPRLIGFRVKPDSADAPDQYACGFDGGIDLQTADVAEIGINGVSFVRTAERRAARHAESEKGNRRRADQDEQSDPKFQYVLFH

SEQ ID NO: 1313 - protein, 378 aa, Neisseria
  VARIANT (1)...(378): Xaa = Any Amino Acid
MVCRLFAAVFGFQLGNQSVHAFRFDNFAELVAVHGNQARAFDGDVVGTVFTAALVGGEVHVDGFLPGYADFGADDDFFAAFIDDGIVFDVDVGVFXFQHRAGIGADQQGLKFFGQRLFLRVGRGAPRVADRQCGHTLEIEIGNRIGFGFLASGVGIAVFXDAQYLSGVLTDLAYRVGRGGKCHADAQNTDAQCADEGGFFHDXVSXFEYDGIRLFGGFFRIAAVGIFLGKTRHEFADKVFQNHCRTGYGDGVAGSKVFRVAALLQPDVLLAQKSRSQDLRGNVAAELILAVQIEAHPRLIGFRVKSDSADAPDQYACGFDGGIDLQTADVAEIGINGVSFVRTAERRTAGHAESEKGNRRRANQDEQSDPKFQYVLLH

SEQ ID NO: 1314 - protein, 374 aa, Neisseria
  VARIANT (1)...(374): Xaa = Any Amino Acid
MAYGLLAAVXSLQLXNQSVHAFRFDNFAELVAVHGNQARAFDGDVVGTVFTAALVGGEVHVDGFLPGXADFGADDDFFAAFIDDXIVFDVDVGVFFQHRAGIGADQQGLKFFGQRLFLRVGRGAPRVADRQCGHTLEIEIGNRIGFGFLAGGVGITAFDAQYLSGVLTDLVYRVGRGGKCHADAQNTDAQCADEGGFFHDVSFEYDGIRLFGGFFRIAAVGIFLGKTRHEFADKVFQNHCRTGYGDGVAGSKVFRVAALLQPDVLLAQKSRSQDLRGNVAAELILAVQIEAHPRLIGFRVKSDSADAPDQYACGFDGGIDLQTADVAEIGINGVSFVRTAERRTAGHAESEKGNRRRANQDEQSDPKFQYVLFH

SEQ ID NO: 1315 - protein, 162 aa, Neisseria
MKKILTAAAVALIGILLATVLIPDSKTAPAFSLPDLHGKTVSNADLQGKVTLINFWFPSCPGCVSEMPKVTKTANDYKNKDFQVLAVAQPIDPIESVRQYVKDYGLPFTVIYDADKAVGQAFGTQVYPTSVLIGKKGEILKTYVGEPDFGKLYQEIDTALAQ

SEQ ID NO: 1316 - protein, 161 aa, Neisseria
  VARIANT (1)...(161): Xaa = Any Amino Acid
MXKILTAAVVALIGILLAIVLXPDSKTAPAFSXPDLHGKTVSNADLQGKVTLINFWFPSCPGCVSXMPKIIKTANDYKXKNFQVLAVAQPIDPIESVRQYVKDYGLPFTVMYDADKAVGQAFGTQVYPTSVLIGKGEIFKTYVGEPDFGKLYQEIDTRVAQ

SEQ ID NO: 1317 - protein, 162 aa, Neisseria
  VARIANT (1)...(162): Xaa = Any Amino Acid
MKKILTAAVVALIGILLAIVLIPDSKTAPAFSLSXLHGKXVXNADLQGXVXLIXFWFPSCPGCVSEMXXIIKTANDYKNKNFQVLAVAQPIDPIESVRQYVKDYGLPFTVMYDADKAVGQAFGTQVYPTSVLIGKKGEILKTYVGEPDFGKLYQEIDTALAQ

SEQ ID NO: 1318 - protein, 141 aa, Neisseria
MFVDNGFNKTVASFAQIVETFDVFFFRNDCAFFTQMKQRCGWVCSLVYLVDIFTRCGFEIPNRSFKELGLLIQISLSERFRTNAEVEMDAHYFPLLRKYLKFIMLHIVTNIRVFCVCVKELLTILVKNLSPNGKKRFVFCC

SEQ ID NO: 1319 - protein, 142 aa, Neisseria
  VARIANT (1)...(142): Xaa = Any Amino Acid
MFVDNGFNKTVASFAQIVETFDVFFFRNDCAFFTQMKQRCGWVCSLVYLVDIFPRCGFEIPNRSFKELGLLIQISLSERFRTNAEVEMDAHYFPLLRKYLKFIMLHIFTNIKVFXCVCVKELLTILVKNLSPNGKKRFVFCC

SEQ ID NO: 1320 - protein, 127 aa, Neisseria
  VARIANT (1)...(127): Xaa = Any Amino Acid
MFVDNGFNKTVASFAQIVETFDVFFFRNNCTFFTQMKQRCGWVCSLVYLVDIFPRCGFEIPNRSFKELGLLIQISLSERFRTNAEVEIDAHYFPLLRKYLKFIMLHIFTNIKVFXCVCVKELLTILV

SEQ ID NO: 1321 - protein, 217 aa, Neisseria
MFSVPRSFLPGVFVLAALAACKPQDNSAAQAASSSASAPAAENAAKPQTRGTDMRKEDIGGDFTLTDGEGKPFSLSDLKGKVVILSFGFTHCPDVCPTGLLTYSDTLKQLGGQAKDVKVVFVSIDPERDTPEIIGKYAKQFNPDFIGLTATGGQNLPVIKQQYRVVSAKINQKDDSENYLVDHSSGAYLIDKNGEVAIFSPYGSEPETIAADVRTLL

SEQ ID NO: 1322 - protein, 217 aa, Neisseria
  VARIANT (1)...(217): Xaa = Any Amino Acid
MFSVPRSFLPGVFVLAALAACKPQDNSAAQVASSSASASAAENAAKQXTRGTDMRKEDIGGDFTLTDGEGKPFNLSDLKGKVVILSFGFTHCPDVCPTELLTYSDTLKQLGGQAKDVKVVFVSIDPERDTPEIIGKYAKQFNPDFIXLTATGGQNLPVIKQQYRVVSAKVNQXDDSENYLVDHSSGAYLIDKNGEVAIFSPYGSEPETIAADVRTLL

SEQ ID NO: 1323 - protein, 217 aa, Neisseria
MFSVPRSFLPGVFVLAALAACKPQDNSAAQVASSSASASAAENAAKPQTRGTDMRKEDIGGDFTLTDGEGKPFNLSDLKGKVVILSFGFTHCPDVCPTELLTYSDTLKQLGGQAKDVKVVFVSIDPERDTPEIIGKYAKQFNPDFIGLTATGDQNLPVIKQQYRVVSAKVNQKDDSENYLVDHSSGAYLIDKNGEVAIFSPYGSEPETIAADVRTLL

SEQ ID NO: 1324 - protein, 314 aa, Neisseria
MITDRFHLFHFPVSFIYQSDNKMPPENSSDGILTTNGLQLPFAQLGSVSFQICNRTGCHAAFHRCFGGSRSDARQQAGIERSRNQVFRAEFEFLTVSGNHFFGYFFHRQICQSIHAGAFHFFVDGGCADIQRAPEDEREAQYVVHLVREVGAAGTDNHVRTGFFRQRRQDFRIRVGHGEHDGFFVHRVQHFRRQQVCAGEAQEDVFAFNRIGKYAPAVVFNGVEFFGFVHAVFVFAGLVNHAFGVANGYVFTFQAQIQQLVQAGNRGGTCAGAHQSRFFDFTAGITQGVQYGGGGNDGRAVLVIMKYGDFAAFA

SEQ ID NO: 1325 - protein, 106 aa, Neisseria
  VARIANT (1)...(106): Xaa = Any Amino Acid
DGIGKHALAVVFNGVELFGLVHTVFVFAGLVNHAFGVANGHVFAFQAQIQQLXQAGNRGRTCAGTHQSRFFDFTAGKTXGVQYGGGGNDGRAVLVVVEYGDFAAFA

SEQ ID NO: 1326 - protein, 299 aa, Neisseria
LYQSDSKMPPENSSDGILTANGLQLPFAQLGSVSFQICNRTGCHAAFHRCFGGSRSNARQQAGIERSRNQVFRAEFKFLTVSGNHFFGYLFHRQIRQSIHAGAFHFFVDGRRADIQRTAEDEREAQYIVHLVREVGAAGTDNHVRTGFFRQRRQDFRIRVGHSEHDGFFVHGVQYFRRQQVRAGEAQEDVFAFDGIGKHALAVVFNGVELFGLVHTVFVFAGLVNHAFGVANGHVFAFQAQIQQLVQAGNRGRTCAGTHQSRFFDFTAGKTQGVQYGSGGNDGRAVLVVVEYGDFAAFA

SEQ ID NO: 1327 - protein, 177 aa, Neisseria
MKLKTLLLPFAALALCANAFAAPPGDASLARWLDTQNFDRDIEKNMIEGFNAGFKPYADKALAEMPEAKKDQAAEAFNRYRENVLKDLITPEVKQAVRNTLLKNAREIYTQEEIDGMIAFYGSPVGQSVVAKNPRLIKKSMSEIAVSWTALSGKIARHHLPEFTEELRRIICGGIVD

SEQ ID NO: 1328 - protein, 193 aa, Neisseria
IKLKTLLLPFATLALCTNAFAAPPSDASLARWLDTQNFDRDIEKNMIEGFNAGFKPYADKALAEMPEAKKDQAAEAFNRYRENVLKDLITPEVKQAVRNTLLKNAREIYTQEEIDGMIAFYGSPVGQSVVAKNPRLIKKSMSEIAVSWTALSGKIAQHHLPEFTEELRRIICGGKNPDAGCKQAGQVGKRHQK

SEQ ID NO: 1329 - protein, 193 aa, Neisseria; identical to SEQ ID NO: 1328

SEQ ID NO: 1330 - protein, 195 aa, Neisseria
LNIKLKTLLLPFATLALCTNAFAAPPSDASLARWLDTQNFDRDIEKNMIEGFNAGFKPYADKALAEMPEAKKDQAAEAFNRYRENVLKDLITPEVKQAVRNTLLKNAREIYTQEEIDGMIAFYGSPVGQSVVAKNPRLIKKSMSEIAVSWTALSGKIAQHHLPEFTEELRRIICGGKNPDAGCKQAGQVGKRHQK

SEQ ID NO: 1331 - protein, 195 aa, Neisseria; identical to SEQ ID NO: 1330

SEQ ID NO: 1332 - protein, 263 aa, Neisseria
MDYLQNLSLGLTKKLPVILQTEVAECGLACLAAVAGFYGFYTDLRALRSKYCLSLKGENLADIVRFADDMGLTGRALRLDLDELGSLRLPCILHWDLNHFVVLESVSSDGAAVMDPASGRRKVKTEEISRKFTGIALELWPNTRFEAGEEKQEIRILPMLRGISGLGRTLFQLLALAAAMEVFAFLQNVSFKIGRGESLALIGRSGCGKSTLLDILSGNLPPESGKVMINGHDIYSLPPPFIPQFECDGQGRTMFYSGLNLNR

SEQ ID NO: 1333 - protein, 185 aa, Neisseria
  VARIANT (1)...(185): Xaa = Any Amino Acid
MDYLSRLSFGFNKKLPVILQTEVAECGLACLTSILSYYGFHTDLRTLRQKYTLSLKGANLADIMRFGNEMNLTPRALRLELDELSNLQLPCILHWNLNHFVVLCSISKDSIVIMDPAVGMRKIKMDEVSQKFTGIALELFPNTHFEEKKETKKIKILSLLRGXSGLKRSLIQMLILAISLEVFAL

SEQ ID NO: 1334 - protein, 51 aa, Neisseria
MPHLQNLSLGLKKKLPVILQTEISECGLACLAAVAGFHGFHTNLRALRSKY

SEQ ID NO: 1335 - protein, 389 aa, Neisseria
MTAHKILPVLLPIILGVSHATAASPAPNRPTVHAAPTLQTPETLTAAHIVIDLQSRQTLSAKNTNTPVEPAALTQLMTAYLVFKNMKSGNIQSEENLKIPESAWASEGSRMFVRPGDTVSTDKLLKGMIALCANDAALTLADRLGNGSIENFVQQMNKEARRLGMKNTVFKNPTGLGREGQVSTAKDLSLLSEALMRDFPEYYPLFSIKSFKFENIEQNNRNILLYRDNNVNGLKAGHTESGGYNLAVSYSGNGRHILVITLGSESAETRASDNSKLLNRALQAFDTPKIYPKGKTVAQIQISGGSKKTVRAGFLKEAYITLPHKEAKMAEQILETIQPIPAPVKKGQILGKIKIRQNGHTIAEKEIVALENVEKRSRWQRLWTRLTGQ

SEQ ID NO: 1336 - protein, 389 aa, Neisseria
MTAHKILPVLLSIILGVSHATAASPAPNRPTVHAAPTFQTPETLTAAHIVIDLQSKQILSAKNINTPVEPAALTQLMTAYLVFKNMKSGNIQSEENLKIPESAWASEGSRMFVRPGDTVSTDKLLKGMIALSANDAALTLAGRLGNGSIENFVQQMNKEARRLGMKNTVFKNPTGLSREGQVSTAKDLALLSEALMRDFPEYYPLFSIKSFKFKNIEQNNRNILLYRDNNVNGLKAGHTESGGYNLAVSYSGNGRHILVITLGSESAETRASDNSKLLNWALQAFDTPKIYPKGKTVAQIQISGGSKKTVRAGFLKEAYITLPHKEAKMAEQILETIQPIPAPVKKGQILGKIKIRQNGYTIAEKEIVALENVKKRSRWQRLWACLTGQ

SEQ ID NO: 1337 - protein, 389 aa, Neisseria
MTAHKILPVLLSIILGVSHATAASPAPNRPTAHAAPTFQTPETLTAAHIVIDLQSKQILSAKNINTPVEPAALTQLMTAYLVFKNMKSGNIRSEENLKIPESAWASEGSRMFVRPGDTVSTDKLLKGMIALSANDAALTLAGRLGNGSIENFVQQMNKEARRLGMKNTVFKNPTGLSREGQVSTAKDLAQLSEALMRDFPEYYPLFSIKSFKFKNIEQNNRNILLYRDNNVNGLKAGHTESGGYNLAVSYSGNGRHILVITLGSESAETRASDNSKLLNWALQAFDTPKIYPKGKTVAQIQISGGSKKTVRAGFLKEAYITLPHKEAKMAEQILETIQPIPAPVKKGQILGKIKIRQNGYTIAEKEIVALENVKKRSRWQRLWACLTGQ

SEQ ID NO: 1338 - protein, 139 aa, Neisseria
MDNKTKLRLGGLILLTTAVLSLIIVLIVDSWPLAILLAAVIVAAAAGGFVWTSRRQQRQFIERLKKFDIDPEKGRINEANLRRMYHSGGQHQKDAITLICLSQKCSVDEAHAMFKKRPTRQEINQMAAKQSRGQKRPHR

SEQ ID NO: 1339 - protein, 139 aa, Neisseria; identical to SEQ ID NO: 1338

SEQ ID NO: 1340 - protein, 139 aa, Neisseria; identical to SEQ ID NO: 1338

SEQ ID NO: 1341 - protein, 159 aa, Neisseria
MNKIFLTAAALVLGACGFHLKGADGISPPLTYRSWHIEGGQALQFPLETALYQASGRVDDAAGAQMTLRIDSVSQNKETYTVTRAAVINEYLLILTVEAQVLKRGEPVGKPMTVSVRRILDYADNEILGKQEEEETLWAEMRQDVAEQIVRRLTFLKAE

SEQ ID NO: 1342 - protein, 159 aa, Neisseria
MNKLFLTAAVLMLGACGFHLKGADGISPPLTYRSWHIEGGQALRFPLETALYQASGRVDDAAGAQMTLRIDSVSQNKETYTVTRAAVINEYLLILTVEAQVLKRGEPVGKPMTVSVRRVLAYADNEILGKQEEEAALWAEMRQDAAEQIVRRLTFLKAE

SEQ ID NO: 1343 - protein, 159 aa, Neisseria
MNKLFLTAAVLMLGACGFHLKGADGISPPLTYRSWHIEGGQALQFPLETALYQASGRVDDAAGAQMTLRIDSVSQNKETYTVTRAAVINEYLLILTVEAQVLKRGEPVGKPMTVSVRRVLAYADNEILGKQEEEAALWAEMRQDAAEQIVRRLTFLKAE

SEQ ID NO: 1344 - protein, 106 aa, Neisseria
MDACFFVIPAQAGIRRFGIVFKRSGRILAGAGMMPLYTFSELYMLQQGTAHQAPHCVLPERGCPPIRFYRYKQTGFNRKGMGIKSISDTSRAMPSENQSPLSDGIV

SEQ ID NO: 1345 - protein, 106 aa, Neisseria
  VARIANT (1)...(106): Xaa = Any Amino Acid
MNACFFVIPTQAGIRRFGIVFKRSGRILAGAGMMPLYTFSELYMFQQGTAHQAPHCVLPERDYPPIRFYRHKQTGFNRKGMGIKSISDIXRAMPSENQSPLSDGIV

SEQ ID NO: 1346 - protein, 138 aa, Neisseria
MNACFFVIPTQAGIRRFGIVFKRSGRILAGAGMMPLYIVDIIRTRRRSRRQYKYGKARQRRTGLNLIHYTFSELYMFQQRTAHQAPHCVLPERDCPPIRFYRYKQTGFNRKGMGMKSVSDTSRAMPSENQSPLSDGIV

SEQ ID NO: 1347 - protein, 246 aa, Neisseria
MLIIRNLIYWLILCSSLIFLFPFMLLASPFRDGAHKMARVWVGILNWSLKHIVGLKYRIIGAEHIPDRPSVICAKHQSGWETLALQEIFPPQVYVAKRELFKIPFFGWGLKLVKTIGIDRNNRREANEQLIKQGLARKNEGYWITIFPEGTRLAPGKRGKYKLGGARMAKMFEMDIVPVALNSGEFWPKNSFLKYPGEITVIICPTIPHASGSEAELMEKCEHLIETQQPLISGAGPFAAEMPSET

SEQ ID NO: 1348 - protein, 247 aa, Neisseria
MLIIRNLIYWLILCSTLIFLFPFMLLASPFRDGAHKMARVWVGILNWSLKHIVGLKYRIIGAENIPDRPAVICAKHQSGWETLALQDIFPPQVYVAKRELFKIPFFGWGLKLVKTIGIDRNNRREANEQLIKQGLVRKNEGYWITIFPEGTRLAPGKRGKYKLGGARMAKMFEMDIVPVALNSGEFWPKNSFLKYPGEITVVICPTIPHASGSEAELMEKCEHLIETQQPLISGAGPFAAKMPSETA

SEQ ID NO: 1349 - protein, 247 aa, Neisseria
MLIIRNLIYWLILCSTLIFLFPFMLLASPFRDGAHKMARVWVKILNLSLKHIVGLKYRIIGAENIPDRPAVICAKHQSGWETLALQDIFPPQVYVAKRELFKIPFFGWGLKLVKTIGIDRNNRREANEQLIKQGLARKNEGYWITIFPEGTRLAPGKRGKYKLGGARMAKMFEMDIVPVALNSGEFWPKNSFLKYPGEITVVICPTIPHASGSEAELMGKCEHLIETQQPLISGAGPFAAKMPSETA

SEQ ID NO: 1350 - protein, 590 aa, Neisseria
MILPARFSDGISLSLRLKLLTGLWVGLAALSVVLTLLLSLRLENAASVIEEAGNLRMQAYRLAYMAGEGSPRAQIDNQVAEFEKSLKRIAQSDAIHPLIPSDTPLAYDLIQSMLIIDWQAHILPPLQSYRRPTQVDLYRFAGNIELFLQALENANEKNTWWLRRFQWAIMLMTLVSSVLMLFWHQIWVIRPLQALREGAERIGRRCFDIPVPEGGTPEFKQVGRCFNQMGGRLKILYDDLEGQVAEQTRSLEKQNQNLTLLYQTTRDLHQSYIPQQAAEHFLNRILPAVGADSGRVCLDGGSDVYVSIHHADCGTAASDLGKYHEEIFPIEYQNETLGRLLLSFPNGISLDEDDRILLQTLGRQLGVSLAGAKQEEEKRLLAVLQERNLIAQGLHDSIAQALTFLNLQVQMLETAFAENKREEAAENISFIKTGVQECYEDVRELLLNFRTKISNKEFPEAVADLFARFTQQTGITVETAWENGSFLPPQEAQLQMIFILQESLSNIRKHARATHVKFTLSEHGGRFTMTIQDNGQGFDTEKIGEPTGSHVGLHIMQERAKRIHAVLEIRSQAQQGTTVSLTVASEESLK

SEQ ID NO: 1351 - protein, 590 aa, Neisseria
MILPARFSDGISLSLRLKLLTGLWVGLAALSVVLTLLLSLRLENAASVIEEAGNLRMQAYRLAYMAGEGSPRAQIDNQVAEFEKSLKRIAQSDAIHPLIPSDTPLAYDLIQSMLIIDWQAHILPPLQSYRRPTQVDLYRFAGNIELFLQALENANEKNTWWLRRFQWAIMLMTLVSSVLMLFWHQIWVIRPLQALREGAERIGRRCFDIPVPEGGTPEFKQVGRCFNQMGGRLKILYDDLEGQVAEQTRSLEKQNQNLTLLYQTTRDLHQSYIPQQAAEHFLNRILPAVGADSGRVCLDGGSDVYVSIHHADCGTAASDLGKYHEEIFPIEYQNETLGRLLLSFPNGISLDEDDRILLQTLGRQLGVSLAGAKQEEEKRLLAVLQERNLIAQGLHDSIAQALTFLNLQVQMLETAFAENKREEAAENIGFIKTGVQECYEDVRELLLNFRTKISNKEFPEAVADLFSRFTQQTGTTVETAWENGTHLPTQDEQLQMIFILQESLSNIRKHAHATHIKFRLLKQDGSFTMTIQDNGQGFDTENIGEPSGSHVGLHIMQERAKRIHAVLEIRSQAQQGTTVSLTVASEESLK

SEQ ID NO: 1352 - protein, 208 aa, Neisseria
MASPSSLPFNSGKTKPTAFAAPVLVGIMFSTPLRARRRSLWRTSVTVWSLVSAWMVVIAPLTMPTLSLNTLATGERQLVVQEALETTVMSAVRTLSFTPYTTVASTSSPPGAEMRTFFAPLSRWILAFSLLVNAPVHSMTKSTPSSFHGSSAGLRVEKKGILSPLTMRLPPSWDTSASKRPCTVSNLVRWALVSRLPLALTATIWSWS

SEQ ID NO: 1353 - protein, 208 aa, Neisseria
MASPSSLPFNSGSTKPTAFAAPVLVGIMFSTPLRARRRSLWRTSVTVWSLVSAWMVVIAPLTMPTLSLNTLATGERQLVVQEALETTVMSAVRTLSFTPYTTVASTSSPPGAEMRTFFAPLSRWILAFSLLVNAPVHSMTKSTPSSFHGSSAGLRVEKKGILSPLTMRLPPSWDTSASKRPCTVSNLVRWALVSRLPLALTATSWSWS

SEQ ID NO: 1354 - protein, 207 aa, Neisseria
  VARIANT (1)...(207): Xaa = Any Amino Acid
MASPSSLSFNSGSTKPTAFAAPVLVGIMFSTPLRARRRSLWRTSVTVWSLVSAWMVVIAPLTMPTLSLNTLATGERQLVVQEALETTVMSAVRMLSFTPYTTVASTSSPPGAEMRTFFAPLSRTLAFSLLVNAPVHSMTKSTPSSFHGSSAGLRVXKXGILSPLTMRLPPSWDTSASKRPCTVSNLVRWALVSRLPLALTATIWSWS

SEQ ID NO: 1355 - protein, 2048 aa, Neisseria
  VARIANT (1)...(2048): Xaa = Any Amino Acid
MNKTLYRVIFNRKRGAVVAVAETTKREGKSCADSGSGSVYVKSVSFIPTHSKAFCFSALGFSLCLALGTVNIAFADGIITDKAAPKTQQATILQTGNGIPQVNIQTPTSAGVSVNQYAQFDVGNRGAILNNSRSNTQTQLGGWIQGNPWLTRGEARVVVNQINSSHPSQLNGYIEVGGRRAEVVIANPAGIAVNGGGFINASRATLTTGQPQYQAGDFSGFKIRQGNAVIAGHGLDARDTDFTRILLYANKITLISTAEQAGIRNQGQLFASSGNVAIDANGRLVNSGTMAAANVQDMNNTAEHKVNIRSQAFENSGTAVSQQGTQIHSQSIQNTGKLLSAGTEDLAVSGSLNNQNGEIATNQQLIIHDGQQSTVVIDNTNGTIQSGRDVAIQAKSLSNNGTLAADNKLDIALQDDFYVERKIVAGNELSLSTRGSLKNSHTLQAGKRIRIKANNLDNAVQGNIQSGGTTDIGTQHNLTNRGLIDGQQTKIQAGQMNNIGTGRIYGDNIAIAATRLDNQDENGTGAAIAARENLNLGIEQLNNRENSLIYSGNDMAVGGALDTNDQATGKAQRIHNAGAIIEAAGKMRLGVEKLHNTNEHLKTQLVETGRERIVDYEAFGRHELLREGTQHELGWFVYNNESDHLRTPDGVAHENWHKYDYEKVTQETQVTGTAPAKIIAGSDLIIDSKAVFNSDSRIIAGGQLLVQTEKDGLHNEQTFGEKKVFSENGKLHNYWRARRKGHDETGHREQNYTLPEEITRDISLGSFAYESHSKALSRHAPSQGTELPQSNRDNIRTAKSNGISLPYTPNSFTPLPGSSLYIINPANKGYLVETDPRFANYRQWLGSDYMLGSLKLDPNNLHKRLGDGYYEQRLINEQIAELTGHRRLDGYQNDEEQFKALMDNGATAARSMNLSVGIALSAEQAAQLTSDIVWLVQKEVKLPDGGTQTVLMPQVYVRVKNGGIDGKGALLSGSNTQINVSGSLKNSGTIAGRNALIINTDTLDNIGGRIHAQKSAVTATQDINNIGGILSAEQTLLLNAGNNINNQSTAKSSQNAQGSSTYLDRMAGIYITGKEKGVLAAQAGKDINIIAGQISNQSDQGQTRLQAGRDINLDTVQTGKYQEIHFDADNHTIRGSTNEVGSSIQTKGDVTLLSGNNLNAKAAEVGSAKGTLAVYAKNDITISSGIHAGQVDDASKHTGRSGGGNKLVITDKAQSHHETAQSSTFEGKQVVLQAGNDANILGSNVISDNGTRIQAGNHVRIGTTQTQSQSETYHQTQKSGLMSAGIGFTIGSKTNTQENQSQSNEHTGSTVGSLKGDTTIVASKHYEQTGSNVSSPEGNNLISTQSMDIGAAQNQLNSKTTQTYEQKGLTVGIQFARYRFGTTSDCRSTQSSKQVGQSKNDRVNAMAAANAGWQAYQTGKGAQNLANGTTNAKQVSISITYGEQQNRQTTQVQANQAQASQIQAGGKTTLYCRRCGEQSNINITGSGVSGRAGTGLIADKQIHLQSAEQSNTERSQNKSAGWNAGAAVSFGQGGWSLGVAAGGNVGKGYGYGDSVTHRHSHIGDKGSQTLIQSGGDTIIKGAQVRGKGVQVNAKNLSIQSVQDRETYQSKQQNAGAQVTVGYGFSASGDYSQSKIRADHASVTEQSGIYAGEDGYQIKVGNHTGLKGGIITSSQSAKDKGKNRFSTGTLAGSDIQNYSQYEGKSFGLGASVAVSGKTLGQGAKNKPQDKHLTSIADKNGASSSVGYGSDSDSQSSITKSGINTPKNIQITDEAAQIRLTGKIAAQTKADIDTNVTTDTAERHSGSLKNIFDKDRVQSELDLQRTVSQDFSKNVQQTNTEINQHLDKLKADKEAAETAAAEALANGDMETAKRKAHEAQDAAAKADNWQQGKVILNMLASGLAEPTQSGAGIAAATASPDVSYAIGQHFKDLAGQNANGKLTASQETAHVLAHAVLGAAVAAAXGNNAPAGALGAGGSEAAAPIIGKWLYGKGDGGSLNAEEKETVSAITRMLGTAAGAAEGNSSADAVWGCFQTASDFASSFSYPINM

SEQ ID NO: 1356 - protein, 2514 aa, Neisseria
MNKTLYRVIFNRKRGAVVAVAETTKREGKSCADSDSGSAHVKSVPFGTTHAPVCRSNIFSFSLLGFSLCLAVGTANIAFADGIIADKAAPKTQQATILQTGNGIPQVNIQTPTSAGVSVNQYAQFDVGNRGAILNNSRSNTQTQLGGWIQGNPWLARGEARVVVNQINSSHSSQMNGYIEVGGRRAEVVIANPAGIAVNGGGFINASRATLTTGQPQYQAGDLSGFKIRQGNVVIAGHGLDARDTDFTRILSYHSKIDAPVWGQDVRVVAGQNDVVATGNAHSPILNNAAANTSNNTANNGTHIPLFAIDTGKLGGMYANKITLISTAEQAGIRNQGQLFASSGNVAIDANGRLVNSGTMAAANAKDTDNTAEHKVNIRSQGVENSGTAVSQQGTQIHSQSIQNTGTLLSSGEILIHNSGSLKNETSGTIEAARLAIDTDTLNNQGKLSQTGSQKLHIDAQGKMDNRGRMGLQDTAPTASNGSSNQTGNSYNASFHSSTTTPTTATGTGTATVSISNITAPTFADGTIRTHGALDNSGSIIANGQTDVSAQQGLNNAGQIDIHQLNAKGSAFDNHNGTIISDAVHIQAGSLNNQNGNITTRQQLEIETDQLDNAHGKLLSAEIADLAVSGSLNNQNGEIATNQQLIIHDGQQSTAVIDNTNGTIQSGRDVAIQAKSLSNNGTLAADNKLDIALQDDFYVERNIVAGNELSLSTRGSLKNSHTLQAGKRIRIKANNLDNAAQGNIQSGGTTDIGTQHNLTNRGLIDGQQTKIQAGQMNNIGTGRIYGDNIAIAATRLDNQDENGTGAAIAARENLNLGIGQLNNRENSLIYSGNDMAVGGALDTNGQATGKAQRIHNAGATIEAAGKMRLGVEKLHNTNEHLKTQLVETGREHIVDYEAFGRHELLREGTQHELGWSVYNDESDHLRTPDGAAHENWHKYDYEKVTQKTQVTQTAPAKIISGNDLTIDGKEVFNTDSQIIAGGNLIVQTEKDGLHNEQTFGEKKVFSENGKLHSYWREKHKGRDSTGHSEQNYTLPEEITRNISLGSFAYESHRKALSHHAPSQGTELPQSNGISLPYTSNSFTPLPSSSLYIINPVNKGYLVETDPRFANYRQWLGSDYMLDSLKLDPNNLHKRLGDGYYEQRLINEQIAELTGHRRLDGYQNDEEQFKALMDNGATAARSMNLSVGIALSAEQVAQLTSDIVWLVQKEVKLPDGGTQTVLVPQVYVRVKNGDIDGKGALLSGSNTQINVSGSLKNSGTIAGRNALIINTDTLDNIGGRIHAQKSAVTATQDINNIGGMLSAEQTLLLNAGNNINSQSTTASSQNTQGSSTYLDRMAGIYITGKEKGVLAAQAGKDINIIAGQISNQSEQGQTRLQAGRDINLDTVQTSKHQATHFDADNHVIRGSTNEVGSSIQTKGDVTLLSGNNLNAKAAEVSSANGTLAVSAKNDINISAGINTTHVDDASKHTGRSGGGNKLVITDKAQSHHETAQSSTFEGKQVVLQAGNDANILGSNVISDNGTQIQAGNHVRIGTTQTQSQSETYHQTQKSGLMSAGIGFTIGSKTNTQENQSQSNEHTGSTVGSLKGDTTIVAGKHYEQIGSTVSSPEGNNTIYAQSIDIQAAHNKLNSNTTQTYEQKGLTVAFSSPVTDLAQQAIAVAQSSKQVGQSKNDRVNAMAAANAGWQAYQTGKSAQNLANGTTNAKQVSISITYGEQQNRQTTQVQANQAQASQIQAGGKTTLIATGAAEQSNINIAGSDVAGKAGTILIADNDITLQSAEQSNTERGQNKSAGWNAGAAVSFGQGGWSLGVTAGGNVGKGYGNGDSITHRHSHIGDKGSQTLIQSGGDTTIKGAQVRGKGVQVNAKNLSIQSVQDRETYQSKQQNASAQVTVGYGFSAGGDYSQSKIRADHVSVTEQSGIYAGEDGYQIKVGNHTDLKGGIITSTQSAEDKGKNRFQTATLTHSDIKNHSQYKGESFGLGASASISGKTLGQGAQNKPQNKHLTSVADKNSASSSVGYGSDSDSQSSITKSGINTRNIQITDEAAQIRLTGKTAAQTKADIDTNVTTDTAERHSGSLKNTFNKEAVQSELDLQRTVSQDFSKNVQQANTEINQHLDKLKADKEAAETAAAEALANGDMETAKRKAHEAQDAAAKADNWQQGKVILNMLASGLAAPTQSGAGIAAATASPAVSYAIGQHFKDLAGQNANGKLTASQETAHVLAHAVLGAAVAAVGDNNALAGALSAGGSEAAAPYISKWLYGKEKGSDLTAEEKETVTAITNVLGTATGAAVGNSATDAAQGSLNAQSAVENNDTVEQVKFALRHPRIAIAIGSVHKDPGSTLEPNISTIASTFQLNLFPNSEFGGEGGVGNAFRHVLWQATITREFGKDIAVKVGNSHESGEKINYSIRRNLSLDKADEMIDQLNNEIGREIALNTNRLNTKELVGLILETYKNNGFYQAERNSNGNYDVVRKRLSEKDYQNTSNILIHLDNTGAGFKIQQRRKQIRAQISARQWRR

SEQ ID NO: 1357 - protein, 2599 aa, Neisseria
MNRTLYKVVFNKHRNCMIAVAENAKREGKNTADTQAVGILPNDIAGFAGFIHSISVISFSLSLLLGSALILTSSSATAQGIVADKSAPAQQQPTILQTGNGIPQVNIQTPTSAGVSVNQYAQFDVGNRGAILNNSRSNTQTQLGGWIQGNPWLARGEARVVVNQINSSHSSQLNGYIEVGGRRAEVVIANPAGIAVNGGGFINASRATLTTAQPQYQAGDLSGFKIRQGNVVIAGHGLDARDTDYTRILSYHSKIDAPVWGQDVRVVAGQNDVAATGDAHSPILNNAAANTSNNTANNGTHIPLFAIDTGKLGGMYANKITLISTVEQAGIRNQGQWFASAGNVAVNAEGKLVNTGMIAATGENHAVSLHARNVHNSGTVASQDDANIHSQTLDNSGTVLSSGRLTVRNLGRLKNQNNGTIQAARLDMSTGGLDNTGNITQTGSQALDLVSAGKFDNSGKIGVSDVPQTGLNPNPSVIPQIPSTATGSGSSTVSVSKPGSNNPVSPTAPAKNYAVGRIQTTGAFDNAGSINAGGQIDIAAQNGLGNSGSLNAAKLRVSGDSFNNTVKGKLQAHDLAVNTQTAKNSGHLLTQTGKIDNRELHNAGEIAANNLTLIHSGRLSNDKKGNIRAAHLQLDTAGLHNAGNILADSGTVTTKNNLRNTGKVSVARLNTEGQTLDNTRGRIEAETVNIQSQQLTNQSGHITATEQLTINSRNVDNQNGKLLSANQAQLAVSDGLYNQHGEIATNRQLSIHDKNQNTLALNNADGTIQSAGNVSLQAKSLANNGTLTAGNKLDIALTDDFVVERDLTAGKQLNLSIKGRLKNTHTLQAGHTLKLNAGNIDNQVTGKIIGGEQTDITSEQHVDNRGLINSDGLTHIGAGQTLTNTGTGKIYGNHIALDAQILLNREETTEGSTKAGAIAARKRLDIGAKEIHNQEGALLSSEGIFAVGNRLDEQHHAAGMADTFVNGSAGLEVQGDALMSVRNMQNINNHFKTETYLAKAEKQVRDYTVLGQNTYYQAGKDGLFDNSQGQKDQTTATFHLKNGSRIEANQWHVRDYHIETYKERIIENRPAHITVGGDLTASGQNWLNKDSRIVVGGRIITDDLNQKEITNQSTTGKGRTDAVGTQWDSVTKKGWYSGRKRQRRTERNHTPYHDTQLFTHDFDTPVSVIQQNAASPSFQPAASAIKLIDGVSTAAVNGQRIHTGNVVSLNNATVTLPNSSLYTTHPDNKGWLVETDPQFADYRRWLGSDYMLQQLQLDTNHLHKRLGDGYYEQKLVNEQIHQLTGYRRLDGYRSDEEQFKALMDNGLTAAKTFGLTPGIALSAEQVARLTSDIVWMENQTVTLSDGSTQTVLVPKVYALARKGDLNTSGGLISAEQVLLKLQNGNLTNSGTIAGRQAVLIQARNINSNGNIQADQIGLKAEKSINIDGGQVQAGRLLTAQAQNINLNGTTQTSGNERNGNTAIDRMAGINVVGSHTEQVDNRTSDGILSLHASNDINLNAATVSNQVKDGTTQITAGNNLNLGTIRTEHREAYGTLDDENHRHVRQSTEVGSSIRTQNGALLRAGNDLKIRQGELEAEEGKTVLAAGRDVTISEGRQITELDTSVSGKSKGILSSTKTHDRYRFSHDEAVGSNIGGGKMIVAAGQDINVRGSNLISDKGIVLKAGHDIDISTAHNRYTGNEYHESKKSGVMGTGGLGFTIGNRKTTDDTDRTNIVHTGSIIGSLNGDTVTVAGNRYRQTGSTVSSPEGRNTVTAKSIDVEFANNRYATDYAHTQEQKGLTVALNVPVVQAAQNFIQAAQNVGKSKNKRVNAMAAANAAWQSYQATQQMQQFAPSSSAGQGQNNNQSPSISVSITYGEQKSRNEQKRHYTEAAASQIIGKGQTTLAATGSGEQSNINITGSDVIGHAGTALIADNHIRLQSAKQDGSEQSKNKSSGWNAGVAVKIGNGIRFGITAGGNIGKGKEQGGSTTHRHTHVGSTTGKTTIRSGGDTTLKGVQLIGKGIQADTRNLHIESVQDTETYQSKQQNGNVQVTVGYGFSASGSYRQSKVKADHASVTGQSGIYAGEDGYQIKVRDNTDLKGGIITSSQSAEDKGKNLFQTATLTASDIQNHSRYEGRSFGIGGSFDLNGGWDGTVTDKQGRPTDRISPAAGYGSDGDSKNSTTRSGVNTHNIHITDEAGQLARTGRTAKETEARIYTGIDTETADQHSGHLKNSFDKDAVAKEINLQREVTKEFGRNAAQAVAAVADKLGNTQSYERYQEARTLLEAELQNTDSEAEKAAFRASLGQVNAYLAENQSRYDTWKEGGIGRSILHGAAGGLTTGSLGGILAGGGTSLAAPYLDKAAENLGPAGKAAVNALGGAAIGYATGGSGGAVVGANVDWNNRQLHPKEMALADKYAEALKREVEKREGRKISSQEAAMRIRRQILRWVDKGSQDGYTDQSVISLIGMKGEDKALGYTWDYRDYGARNPQTYNDPKLFEEYRRQDKPEYRNLTWLHSGTKDTKIRQGERKNEEFALNVAEGLTSLVNPNPRIKVPILAGIRNLKNIKPTVTGSDPLLAGAGNIRIPANGNVAKGDRIPDTALASKGIKHKDRKDQLEKK

SEQ ID NO: 1358 - protein, 108 aa, Neisseria
MDSTLSKTCCVSCILLSVTTTIFARPRPAASNTSLRFASPNDTGSPALLATCTRAMSKSSAKYGISSLGEDASDRLPAPAEADNQHMIRLAHRFHQHAVQIERLHVPA

SEQ ID NO: 1359 - protein, 209 aa, Neisseria
MDSTLSKTCCVSCILLSVTTTIFARPRPAASNTSLRFASPNDTGSPALLATCTRAMSKSSAKYGISSWARTRPTVCPPLPKPTISTWSDLLMVSTSILCRSSDFMSQLDLTKRPTSASLPPKRKGAIIIDSRTAAVAACSHSGETISSCPAMASITKPNSPPCARYKAVLRLSPTECFILKAMANTTSAFNTSSIANSINTCRQPPINA

SEQ ID NO: 1360 - protein, 209 aa, Neisseria
MDSTLSKTCCVSCILLSVTTTIFARPRPAASNTSLRFASPNDTGSPALLATCTRAMSKSSAKYGISSWARTRPTVCPPLPKPTISTWSDLLMVSTSILCRSSDFMSQLDLTKRPTSASLPPKRKGAIIIDSRTAAVAACSHSSETISSCPAMASITKPNSPPCARYKAVLRLSPTECFILKAMANTTSAFNTSSIANSINTCRQPPINA

SEQ ID NO: 1361 - protein, 116 aa, Neisseria
MPSEQYLFRRHFVWGLTVVQPEYVLHIVQTRFAVYPNCGADGTGGKGHAAAGFVGDFHAFAVGGEEGGVVADYVACADGGKADGGRIARTSVAFAAVNGALFEVAAERAGDDFAHS

SEQ ID NO: 1362 - protein, 116 aa, Neisseria
MPSEQYLFRRHFVWGLTVVQPEYVLHIVQTRFAVDPNCGADGTGGKGHAAAGLVGDFHALAVGGEEGGVVADDVACADGGKADGRRIARTGVAFAAVNGALFEVSAERAGDDFAHA

SEQ ID NO: 1363 - protein, 116 aa, Neisseria
MPSEQYLFRRHFVWGLTVVQPEYVLHIVQTRFTVYPNCGADGAGGKGHAAACLVGDFHALAVGGEEGGVVADDVARADGGKADGGRIARAGVAFAAVNGALFEVSAERAGDDFAHA

SEQ ID NO: 1364 - protein, 213 aa, Neisseria
MRRRAAASTRRVCSPAFIRSYWAMRTCSRRRYAAKRADTACWVRTRALAGAEIELVQEIAREVRLKNALKAVAEDYDFILIDCPPSLTLLTLNGLVAAGGVIVPMLCEYYALEGISDLIATVRKIRQAVNPDLDITGIVRTMYDSRSRLVAEVSEQLRSHFGDLLFETAIPRNIRLAEAPSHGMPVMAYDAQAKGAKAYLALADELAARVSGK

SEQ ID NO: 1365 - protein, 257 aa, Neisseria
MSANILAIANQKGGVGKTTTTVNLAASLASRGKRVLVVDLDPQGNATTGSGIDKAGLQSGVYQVLLGDADVQSAAVRSKEGGYAVLGANRALAGAEIELVQEIAREVRLKNALKAVEEDYDFILIDCPPSLTLLTLNGLVAAGGVIVPMLCEYYALEGISDLIATVRKIRQAVNPDLDITGIVRTMYDSRSRLVAEVSEQLRSHFGDLLFETVIPRNIRLAEAPSHGMPVMAYDAQAKGTKAYLALADELAARVSGK

SEQ ID NO: 1366 - protein, 257 aa, Neisseria
MSANILAIANQKGGVGKTTTTVNLAASLASRGKRVLVVDLDPQGNATTGSGIDKASLQSGVYQVLLGDADVKSAAVRSKEGGYGVLGANRALAGAEIELVQEIAREVRLKNALKAVAEDYDFILIDCPPSLTLLTLNGLVAAGGVIVPMLCEYYALEGISDLIATVRKIRQAVNPDLDITGIVRTMYDSRSRLVAEVSEQLRSHFGDLLFETVIPRNIRLAEAPSHGMPVMAYDAQAKGAKAYLALADELMARVSGK

SEQ ID NO: 1367 - protein, 154 aa, Neisseria
MLRVRPVLFAVKASASSIPCRICRLKRSRLPNIFRRILFSCRRRTCFCKACKNSPIRNETSSSGRRQFSVEKANTVRYCTPSLAQCFTIFSNASKPRLCPIIRGRKRFFAQRPLPSIITAMCLGMAVCSKMVCVLLFISAFRGSAFKCRLNAAP

SEQ ID NO: 1368 - protein, 257 aa, Neisseria
MLRVRPVLFAVNASASSMPCRICRLKRSRLPNIFRRILFSCRRRTCFCKACKNSPIRNETSSSGRRQFSVEKANTVRYCTPSLAQCFTIFSNASKPRLCPIMRGRKRFFAQRPLPSIITAICLGMAVCSKTACVLLFMSAFRGSAFKCRLNAEPCRLNCHQIFFFGSQEFVGFGNVFVGQFLNRFFAATCLVFGNFFVFEEFFDVVVGIAAHVADRDAAFFRFAAYDFNQVFAAFLGQHGHRHADQVADSCRVQSQV

SEQ ID NO: 1369 - protein, 256 aa, Neisseria
MLRVRPVLFAVKASASSMPFRIRLKRSRLPSIFRRILFSCRRRTCFCKACKNSPIRNETSSSGRRQFSVEKANTVRYCTPSLAQCFTIFSNASKPRLCPIMRGRKRFFAQRPLPSIITAICLGMAVCSKTACVLLFMSAFRGSAFKCRLNAEPCRLNCHQIFFFGSQEFVGFGNVFVGQFLNRFFAATCLVFGNFFVFEEFFDVVVGIAAHVADGDAAFFRFAAYDFNQVFAAFLGQHGHRHADQVADSCRVQSQV

SEQ ID NO: 1370 - protein, 130 aa, Neisseria
MLKQRVITAMWLLPLMLGMLFYAPQWLWAAFCGLIALTALWEYARMAGLCKTETNHYLAATLVFGVVAYAGGWMLPNLVWYVVLAFWLAVMPLWLRFKWRLNGGWQVYAVGWLLLMPFWFALVSLAPASR

SEQ ID NO: 1371 - protein, 265 aa, Neisseria
MLKQRVITAMWLLPLMLGMLFYAPQWLWAAFCGLIALIALWEYARMGGLCKIKTNHYLAATLVFGVVAYAGGWMLPNLVWYVVLAFWLAVMPLWLRFKWRLNGGWQVYAVGWLLVMPFWFALVSLRPHPDDALPLLAVMGLVWVADICAYFSGKAFGKHKIAPAISPGKSWEGAIGGAVCVAVYMTAVRSAGWLAFDTGWFDTVLIGLVLTVVSVCGDLLESWLKRAAGIKDSSKLLPGHGGVFDRTDSLIAVISVYAAMMSVLN

SEQ ID NO: 1372 - protein, 265 aa, Neisseria
MLKQRVITAMWLLPLMLGMLFYAPQWLWAAFCGLIALIALWEYARMGGLCKIKTNHYLAATLVFGVVAYAGGWMLPNLVWYVVLAFWLAVMPLWLRFKWRLNGGWQVYAVGWLLVMPFWFALVSLRPHPDDALPLLAVMGLVWVADICAYFSGKAFGKHKIAPAISPGKSWEGAIGGAVCVAVYMTAVRSAGWLAFDTGWFDTVLIGLVLTVVSVCGDLLESWLKRAAGIKDSSNLLPGHGGVFDRTDSLIAVISVYAAMMSVLN

SEQ ID NO: 1373 - protein, 166 aa, Neisseria
MIRLTRAFAAALIGLCCTTGAHADTFQKIGFINTERIYLESKQARNIQKTLDGEFSARQDELQKLQREGLDLERQLAGGKLKDAKKAQAEEKWRGLVEAFRKKQAQFEEDYNLRRNEEFASLQQNANRVIVKIAKQEGYDVILQDVIYVNTQYDVTDSVIKEMNAR

SEQ ID NO: 1374 - protein, 166 aa, Neisseria
MTRLTRAFAAALIGLCCTAGAHADTFQKIGFINTERIYLESKQARKIQKTLDSEFSARQDELQKLQREGLDLERQLAEGKLRNAKKAQAEEKWRGLVAAFRKKQAQFEEDYNLRRNEEFASLQQNANRVIVKIAKQEGYDVILQNVIYVNTQYDVTDSVIKEMNAR

SEQ ID NO: 1375 - protein, 166 aa, Neisseria
MTRLTRAFAAALIGLCCTAGAHADTFQKIGFINTERIYLESKQARKIQKTLDSEFSARQDELQKLQREGLDLERQLAEGKLKDAKKAQAEEKWCGLVAAFRKKQAQFEEDYNLRRNEEFASLQQNANRVIVKIAKQEGYDVILQDVIYVNTQYDVTDSVIKEMNAR

SEQ ID NO: 1376 - protein, 119 aa, Neisseria
MRVFRVNRFVVTVFGGGIGSAVPHAACVGKQAQADGACVFRTGHREEQLGGDVGFFVAAVADFFAVFVIHFRAERAAFVAAHRTQAAAVEVFKEGDFFGSAVAARNADFAAEHQREGFA

SEQ ID NO: 1377 - protein, 160 aa, Neisseria
MGIAGAVNVLNPAAGRGTAVVVVGFAVPHAACVGKQAQADGARVFRAGHREEQLGGDVGFFVAAVADFFAVFVIDFRTERAAFVSAHRTQAAAVEVFKEGDFFGSAVAARNADFAAEHQREGFAQGEEPGLVVGGGVVLQFAARQGDFGVHARQVAARRP

SEQ ID NO: 1378 - protein, 159 aa, Neisseria
MGIAGAVNVLNPAAGRGTAVVVVGFAVPHAACVGKQAQADGARVFRAGHREEQLGGDVGFFVAAVADFFAVFVIHFRTERAAFVSAHRTQAAAVEVFKEGDFFGSAVAARNADFAAEHQREGFAGEEPGLVVGGGVVLQFAAGQGDFGVHARQVAARRP

SEQ ID NO: 1379 - protein, 250 aa, Neisseria
MCAIVGAAGLPSALAAAQKGKTIYLANKETLVVSGALFMETARANGAAVLPVDSEHNAIFQVLPRDYTDRLNEHGIDSIILTASGGPFLTTDLSTFDSITPEQAVKHPNWRMGRKISVDSATMANKGLELIEAHWLFNCPPDKLEVVIHPQSVIHSMVRYRDGSVLAQLGNPDMRTPIAYCLGLPERIDSGVGKLDFGALSALTFQKPDFGRFPCLKFAYETINAGGAAPCVLNAANETAVAAFLDGQIK

SEQ ID NO: 1380 - protein, 295 aa, Neisseria
MCAIVGAVGLPSALAAAQKGKTIYLANKETLVVSGALFMETARANGAAVLPVDSEHNAVFQVLPRDYAGRLNEHGIASIILTASGGPFLTADLNTFDRITPAQAVKHPNWRMGRKISVDSATMMNKGLELIEAHWLFNCPPDKLEVVIHPQSVIHSMVRYRDGSVLAQLGNPDMRTPIAYCLGLPERIDSGVGDLDFDALSALTFQKPDFDRFPCLRLAYEAMNAGGAAPCVLNAANEAAVAAFLDGQIKFTDIAKTVAHCLAQDFSDGIGDIGGLLAQDARTRAQARAFIGTLR

SEQ ID NO: 1381 - protein, 295 aa, Neisseria
MCAIVGAVGLPSALAAAQKGKTIYLANKETLVVSGALFMETARANGAAVLPVDSEHNAVFQVLPRDYTGRLNEHGIASIILTASGGPFLTADLNTFDSITPDQAVKHPNWRMGRKISVDSATMMNKGLELIEAHWLFNCPPDKLEVVIHPQSVIHSMVRYRDGSVLAQLGNPDMRTPIAYCLGLPERIDSGVGDLDFDALSALTFQKPDFDRFPCLKLAYEAMNAGGAAPCVLNAANEAAVAAFLDGQIKFTDIAKTVAHCLSQDFSDGIGDIGGLLAQDARTRAQARAFIGTLR

SEQ ID NO: 1382 - protein, 364 aa, Neisseria
MPCLCRLNRNIGSFQITNLTDHNDVRVLTQERLQSSGKSQTLLIIDVNLIDARQVNLGRVFRRCNIYRLRIQNIQTGIERHRLTRTRRTGYQHHPVRTVNRFQQQFFLERLKTELVDVQRRGIGIQNPHHDLFAKQRRQCADTEIDRLAALLKGQLHPTVLRYPFFGNVQTRHYLNPGSKLPPYRNGRLNHLAELPVHTETDTRIVFVKLEMDVGCPATQGIRQSFMDKPRNRAVFCLLVVDIQGVAFLFLLPLPKLLKQRCRTRTHPIEQTRQLVILDNDQLNRNPCGRNRFLNLRHLGRIGNRKKYFVAPTENRHTVELHHLLLRQHPHQHPVARIMTQIKNRITEHPRNQCRKRLGRNDTV

SEQ ID NO: 1383 - protein, 363 aa, Neisseria
  VARIANT (1)...(363): Xaa = Any Amino Acid
MPCLCRLNRNIGSFQITNLTDHNDVRVLTQERLQSSGKSQALLIIDVNLIDARQVNLGRVFRRCNIYRLRIQNIQTGIERHRLTRTRRTGYQHHPVGTVNRYQHXFFLKRLKTELVDVQRRGIGIQNPHHDLFAKQRRQCADTEIDRLAALLKGQLHPAVLRYPFFGNVQTRHYLNPSKLPPYRNGRLNHLAELPVHTETDTGIVFVKLEMDVRCPAAQGIRQSLMDKPRNRAVFCLLVVDIQGVAFLFLLPLPKLLKQRCRTRTHPIEQTRQLVILDNDQLNLNPCGRNGFLNLRHLCRIGNRKKYFVAPTENRHTVELHHLLLRQHPHQHPVARIMTQIKNRITEHPRNQCRKRLGRNDTV

SEQ ID NO: 1384 - protein, 364 aa, Neisseria
MPCLCRLNRNIGSFQITNLTDHNDVRVLTQERLQSSGKSQTLLIIDVNLIDARQVNLGRVFRRCNIYRLRIQNIQTGIERHRLTRTRRTGYQHHPVGTVNRFQQQFFLKRLKTELVDVQRRGIGIQNPHHDLFAKQRRQCADTEIDRLAALLKGQLHPAVLRYPFFGNVQTRHYLNPGSKLPPYRNGRLNHLAELPVHTETDTGIVFVKLEMDVRCPAAQGIRQSLMDKPRNRAVFCLLVVDIQGVAFLFLLPLPKLLKQRCRTRTHPIEQTRQLVILDNDQLNLNPCGRNGFLNLRHLCRIGNRKKYFVAPTENRHTVELHHLLLRQHPHQHPVARIMTQIKNRITEHPRNQCRKRLGRNDTV

SEQ ID NO: 1385 - protein, 402 aa, Neisseria
MLPNLPNSLKKADMDNELWIILLPIILLPVFFTMGWFAARVDMKTVLKQAKSIPSGFYKSLDALVDRNSGRAARELAEVVDGRPQSYDLNLTLGKLYRQRGENDKAINIHRTMLDSPDTVGEKRARVLFELAQNYQSAGLVDRAEQIFLGLQDGEMAREARQHLLNIYQQDRDWEKAVETAQLLSHDEQTYQFEIAQFYCELAQAALFKSNFDAARFNVGKALEANKKCTRANMILGDIEHRQGNFPAAVEAYAAIEQQNHAYLSMVGEKLYEAYAAQGKPEEGLNRLTGYMQTFPELDLINVVYEKSLLLKGEKEAAQTAVELVRRKPDLNGVYRLLGLKLSDLDPAWKADADMMRSVIGRQLQRSVMYRCRNCHFKSQVFFWHCPACNKWQTFTPNKIEV

SEQ ID NO: 1386 - protein, 402 aa, Neisseria
MRPNLPNSLKKADMDNELWIILLPIILLPVFFAMGWFAARVDMKTVLKQAKSIPSGFYKSLDALVDRNSGRAARELAEVVDGRPQSYDLNLTLGKLYRQRGENDKAINIHRTMLDSPDTVGEKRARVLFELAQNYQSAGLVDRAEQIFLGLQDGKMAREARQHLLNIYQQDRDWEKAVETARLLSHDDQTYQFEIAQFYCELAQAALFKSNFDVARFNVGKALEANKKCTRANMILGDIEHRQGNFPAAVEAYAAIEQQNHAYLSMVGEKLYEAYAAQGKPEEGLNRLTGYMQTFPELDLINVVYEKSLLLKCEKEAAQTAVELVRRKPDLNGVYRLLGLKLSDMNPAWKADADMMRSVIGRQLQRSVMYRCRNCHFKSQVFFWHCPACNKWQTFTPNKIEV

SEQ ID NO: 1387 - protein, 402 aa, Neisseria
MRPNLPNSLEKADMDNELWIILLPIILLPVFFAMGWFAARVDMKTVLKQAKSIPSGFYKSLDALVDRNSGRAARELAEVVDGRPQSYDLNLTLGKLYRQRGENDKAINMHQTLLDSPDTTGAKRARVLFELAQNYQSAGLVDRAEQIFLGLQDGEMAREARQHLLNIYQQDRDWEKAVETARLLSHDDQTYQFEIAQFYCELAQAALFKSNFDAARFNVGKALEANKKCTRANMILGDIEHRQGNFPAAVEAYAAIEQQNHAYLSMVGEKLYEAYAAQGKPEEGLNRLTGYMQTFPELDLINVVYEKSLLLKCEKEAAQTAVELVRRKPDLNGVYRLLGLKLSDLDPAWKADADMMRSVIGRQLQRSVMYRCRNCHFKSQVFFWHCPACNKWQTFTPNKIEV

SEQ ID NO: 1388 - protein, 186 aa, Neisseria
MPCLRRQAARCTNRRTDRQTVRFRFLLRQKPVRQVRQRVRRQLHWLFPQQVRKRCYRFRRSACRWQKRRLLGGADSAAVSDAAVFAAGTGPGWRSVAEAGVSDTAGLGSGRTAGFSAFASGAATFASGFSTGFSTGFSIGFSTVACLDGSDGMDAVSALGFAVCGLGCSALIFLGAAALILFRFGM

SEQ ID NO: 1389 - protein, 344 aa, Neisseria
MVSGEEAFRKPASPEGEAGFAEAVSSVPIWLFEGRLSEKSVSTVSGLFSAVWATDSGSGVSMTISTGLYGLKVSGSYTLSVDSMAFQSASARFWVSSSCVSAPDKMPFCAAARLSKSKSMRLEGVSVSTSNVCFADNSSSDSPSKASVSFTSFFGAGSGVAGVSTSAKVISMPSSAASSRSGSSSGTDSSVRRARLDWARRKSSSRAINAAPPPASSKVYEPPNRPSNSPLSVSSSAETCSTGSETALPVSSVGVSMAEAAASWGADSAAVSDAAVFAAGTGSGRTAGFSAFASGAATFASGFSTGFSTVACLDGSDGMDAVSALGFAVCGLGCSALILFRFGM

SEQ ID NO: 1390 - protein, 340 aa, Neisseria
MVSGEEAFRKPASPEGEAGFAEAVSSVPIWLFEGRLSEKSVSTVSGLFSAVWATDSGSGVSMTISTGLYGLKVSGSYTLSVDSMAFQSASARFWVSSSCVSAPDKMPFCAAARLSKSKSMRLEGVSVSTSNVCFADNSSSDSPSKASVSFTSFFGAGSGVAGVSTSAKVISMPSSAASSRSGSSSGTDSSVRRARLDWARRKSSSRAINAAPPPASSKVYEPPNSPLSVSSSAETCSTGSETALPVSSVGVSMAEAAASWGADSAAVSDAAVFAAGTGSGRTAGFSAFASGAATFASGFSTGFSTVACLDGSDGMDAVSALGFAVCGLGCSALILFRFGM

SEQ ID NO: 1391 - protein, 215 aa, Neisseria
MGVDIGRSLKQMKEQGAEIDLKVFTDAMQAVYDGKEIKMTEEQAQEVMMKFLQEQQAKAVEKHKADAKANKEKGEAFLKENAAEDGVKTTASGLQYKITKQGEGKQPTKDDIVTVEYEGRLIDGTVFDSSKANGGPATFPLSQVIPGWTEGVRLLKEGGEATFYIPSNLAYREQGAGEKIGPNATLVFDVKLVKIGAPENAPAKQPDQVDIKKVN

SEQ ID NO: 1392 - protein, 222 aa, Neisseria
MQQASYAMGVDIGRSLKQMKEQGAEIDLKVFTEAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPVTFPLSQVIPGWTEGVQLLKEGGEATFYIPSNLAYREQGAGDKIGPNATLVFDVKLVKIGAPENAPAKQPAQVDIKKVN

SEQ ID NO: 1393 - protein, 272 aa, Neisseria
MNTIFKISALTLSAALALSACGKKEAAPASASEPAAASSAQGDTSSIGSTMQQASYAMGVDIGRSLKQMKEQGAEIDLKVFTEAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPVTFPLSQVILGWTEGVQLLKEGGEATFYIPSNLAYREQGAGDKIGPNATLVFDVKLVKIGAPENAPAKQPAQVDIKKVN

SEQ ID NO: 1394 - protein, 272 aa, Neisseria
MNTIFKISALTLSAALALSACGKKEAAPASASEPAAASAAQGDTSSIGSTMQQASYAMGVDIGRSLKQMKEQGAEIDLKVFTDAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPATFPLSQVIPGWTEGVRLLKEGGEATFYIPSNLAYREQGAGEKIGPNATLVFDVKLVKIGAPENAPAKQPDQVDIKKVN

SEQ ID NO: 1395 - protein, 272 aa, Neisseria
MNTIFKISALTLSAALALSACGKKEAAPASASEPAAASSAQGDTSSIGSTMQQASYAMGVDIGRSLKQMKEQGAEIDLKVFTEAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPVTFPLSQVIPGWTEGVQLLKEGGEATFYIPSNLAYREQGAGDKIGPNATLVFDVKLVKIGAPENAPAKQPAQVDIKKVN

SEQ ID NO: 1396 - protein, 272 aa, Neisseria; identical to SEQ ID NO: 1393

SEQ ID NO: 1397 - protein, 160 aa, Neisseria
MERSGVFGKIVGNRILRMPSEHAAAFYPKPCKSFKLTQSWFRVRSCPCGVFIYGANMKLIYTVIKIIILLLFLLLAVINMDAVTFSYLPGQSVNLPLIVVLFGAFVVGIVFGMFALFGRLLSLRGENSRLRAEVKKSARLSGQKLTAPPIQNAAESAKQP

SEQ ID NO: 1398 - protein, 160 aa, Neisseria
MERNGVFGKIVGNRILRMSSEHAAASYPKPCKSFKLAQSWFRVRSCLGGVFIYGANMKLIYTVIKIIILLLFLLLAVINTDAVTFSYLPGQKFDLPLIVVLFGAFVVGIIFGMFALFGRLLSLRGENGRLRAEVKKNARLTGKELTAPPAQNAPESTKQP

SEQ ID NO: 1399 - protein, 160 aa, Neisseria
MERNGVFGKIVGNRILRMSSEHAAASYPKPCKSFKLAQSWFRVRSCPGGVFIYGANMKLIYTVIKIIILLLFLLLAVINTDAVTFSYLPGQKFDLPLIVVLFGAFVVGIVFGMFALFGRLLSLRGENGRLRAEVKKNARLTGKELTAPPAQNAPESAKQP

SEQ ID NO: 1400 - protein, 106 aa, Neisseria
MGKLDIGILFADFFKDFAPQFGGFQNVGFAYGADFFAAFLGGLEGHVGDAADFAFAVFHGVVAFVFAVFQNTDAARFAEINIAGKFAHNQNIQTGNDFRLERGGVG

SEQ ID NO: 1401 - protein, 106 aa, Neisseria
MGKLDIRVLFADFFKDFAPQFGGFQNVGFAYGTDFFAAFLGGLEGNMGNTADFAFAVFHGVVAFAFAVFQNADAARFAEIDVAGEFAHNQNIQTGNDFRLQRGGVG

SEQ ID NO: 1402 - protein, 106 aa, Neisseria
MGKLDIRVFFADFFKDFAPQFGGFQNVGFAYGADFFAAFLGGLEGDVGNTADFAFAVFHGVVAFAFAVFQNTDAARFAEINIAGEFAHNQNIQTRNDFRLERGGVG

SEQ ID NO: 1403 - protein, 231 aa, Neisseria
MRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSSLPLCRAQVIVGVDYNCDLKVAKEAVLKAAAEHPLSVQNEERQPAAYITALGDNAIEITLWAWANEADRWTLQCDLNEQVVENLRKVNINIPFPQRDIHIINS

SEQ ID NO: 1404 - protein, 231 aa, Neisseria
MRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSTLPLCRAQVIVGVDYNCDLKVAKEAVLKAAVEHPLSVQNEERQAAAYITALGDNAIEITLWAWANEADRWTLQCDLNEQVVENLRKVNINIPFPQRDIHIINS

SEQ ID NO: 1405 - protein, 231 aa, Neisseria; identical to SEQ ID NO: 1404

SEQ ID NO: 1406 - protein, 282 aa, Neisseria
MDFKQFDFLHLISVSGWGHLAEKAWAFGLNLAAALLIFLVGKWAAKRIVAVMRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSSLPLCRAQVIVGVDYNCDLKVAKEAVLKAAAEHPLSVQNEERQPAAYITALGDNAIEITLWAWANEADRWTLQCDLNEQVVENLRKVNINIPFPQRDIHIINS

SEQ ID NO: 1407 - protein, 282 aa, Neisseria
MDFKQFDFLHLISVSGWEHLAEKAWAFGLNLAAALLIFLVGKWAAKRIVAVMRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSTLPLCRAQVIVGVDYNCDLKVAKEAVLKAAVEHPLSVQNEERQAAAYITALGDNAIEITLWAWANEADRWTLQCDLNEQVVENLRKVNINIPFPQRDIHIINS

SEQ ID NO: 1408 - protein, 282 aa, Neisseria
MDFKQFDFLHLISASGWEHLAEKAWAFGLNLAAALLIFLVGKWAAKRIVAVMRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSTLPLCRAQVIVGVDYNCDLKVAKEAVLKAAVEHPLSVQNEERQAAAYITALGDNAIEITLWAWANEADRWTLQCDLNEQVVENLRKVNINIPFPQRDIHIINS

SEQ ID NO: 1409 - protein, 100 aa, Neisseria
MDSPKVGCGWMVLPMSAASQPISMARQTSPIMSPPFGPTMPPPMMRPVSASKISLVKPLSQPLAIARPEAAHGKLALVILRPDALADNSVSPTHATSGEV

SEQ ID NO: 1410 - protein, 100 aa, Neisseria
MDSPKVGCGWMVLPMSAASQPISMARQTSPIISPPFGPTMPPPMMRPVSASKISLVKPLSQPLAIARPEAAHGKLALVILRPEALADSSVSPTHATSGEV

SEQ ID NO: 1411 - protein, 100 aa, Neisseria
MDSPKVGCGWMVLPMSAASQPISMARQTSPIMSPPFGPTMPPPMMRPVSASKISLVKPLSQPLAIARPEAAHGKLALVILRPEALADNSVSPTHATSGEV

SEQ ID NO: 1412 - protein, 113 aa, Neisseria
MHFAQLVGQTGIEQNTFCRRGFTRIDMGGNTDVAVQADRGLTSHFISLSKLETEVRECFVGFSHTVYFFTFFQRTATAFGRINQLACQTQIHGFLTTFAGRVANPTHCQSQTA

SEQ ID NO: 1413 - protein, 113 aa, Neisseria
MHFAQLVGQTGIEQNTFCRRGFTRVNMGGNTDVTVQADRGLTSHFISLSKLETEVRECFVGFSHTVYFFTFFQRTATAFGRINQFACQTQVHGFLTTFAGRIANPAHCQSQTA

SEQ ID NO: 1414 - protein, 112 aa, Neisseria
MHFAQLVGQTGIEQNTFCRRGFTRIDMGGNTDVTVQADRGLTSHFISLSKLETEVRECFVGFSHTVYFFTFFQRTATAFGRINQFACQTQVHGFLTTFAGRINPAHCQSQTA

SEQ ID NO: 1415 - protein, 370 aa, Neisseria
MRYILLTGLLPTASAFGETALQCAALTDNVTRLACYDRIFAAQLPSSAGQEGQESKAVLNLTETVRSSLDKGEAVIVVEKGGDALPADSAGETADIYTPLSLMYDLDKNDLRGLLGVREHNPMYLMPFWYNNSPNYAPSSPTRGTTVQEKFGQQKRAETKLQVSFKSKIAENLFKTRADLWFGYTQRSDWQIYNQGRKSAPFRNTDYKPEIFLTQPVKADLPFGGRLRMLGAGFVHQSNGQSRPESRSWNRIYAMAGMEWGKLTVIPRVWVRAFDQSGDKNDNPDIADYMGYGDVKLQYRLNDRQNVYSVLRYNPKTGYGAIEAAYTFPIKGKLKGVVRGFHGYGESLIDYNHKQNGIGIGLMFNDWDGI

SEQ ID NO: 1416 - protein, 370 aa, Neisseria
MRYILLTGLLPMASAFGETALQCAALTDNVTRLACYDRIFAAQLPSSAGQEGQESKAVLNLTETVRSSLDKGEAVIVVEKGGDALPADSAGETADIYTPLSLMYDLDKNDLRGLLGVREHNPMYLMPLWYNNSPNYAPGSPTRGTTVQEKFGQQKRAETKLQVSFKSKIAEDLFKTRADLWFGYTQRSDWQIYNQGRKSAPFRNTDYKPEIFLTQPVKADLPFGGRLRMLGAGFVHQSNGQSRPESRSWNRIYAMAGMEWGKLTVIPRVWVRAFDQSGDKNDNPDIADYMGYGDVKLQYRLNDRQNVYSVLRYNPKTGYGAIEAAYTFPIKGKLKGVVRGFHGYGESLIDYNHKQNGIGIGLMFNDLDGI

SEQ ID NO: 1417 - protein, 370 aa, Neisseria; identical to SEQ ID NO: 1416

SEQ ID NO: 1418 - protein, 202 aa, Neisseria
MIIDQSQIFTHLAFCAFCGIGAVTAGNRLHNRMYNAAAARGIGRGNGSQQQFGKSETVTDAQRFSSKNGDKQISDTHPQPCFEQTARNHNCDGNQPNQRIGERTQRIAHRRARFVGGYAGYCDQPDGNNRQRAQRHNLADNGGNHTDKHSQQRPSLRLDPVGYGQCQNQGAQYCGNGEGYRFETQFHHIDLRKKDRPEKSEK

SEQ ID NO: 1419 - protein, 202 aa, Neisseria
MIVDQSQIFTHLAFCAFCGIGAVTAGNRLHNRMYNAAAARGIGRGNGSQQQFGKSETVTDAQRFSSKNGDKQISDTHPQPCFEQTARNHNCDGNQPNQRIGERTQRIAHRRARFVGGYAGYCDQPDGNNRQRAQRHGLADNGGNHTDKHGQQRPSLRLDPVGYGQCQNQGAQYCGNGEGYRFETQFHHIDLRKKDRPEKSEK

SEQ ID NO: 1420 - protein, 202 aa, Neisseria
MIVDQSQIFTHLAFCAFCGIGAVTAGNRLHNRMYNAAAARGIGRGNGSQQQFGKSETVTDAQRFSSKNGDKQISDTHPQPCFEQTARNHNCDGNQPNQRIGERTQRIAHRRTRFVGGYAGYCDQPDGNNRQRTQRHGLADNGGNHTDKHGQQRPSLRLDPVGYGQCQNQGAQYCGNGEGYRFETQFHHIDLRKKDRPEKSEK

SEQ ID NO: 1421 - protein, 234 aa, Neisseria
MLRSILAASLLAVSFPAAAEALNYNIVEFSESAGIEVAQDTMSARFQVAAEGRDKNAVNAEFVKKFNNFTRKSKNGSFKTELVSRSAMPRYQYTNGRRIQTGWEERAEFKAEGRDFDALNRFIADVQTDASLEDTDFSVSRERRNEVIDQVSKDAVLRFKARAEKLAGVLGASGYKIVKLNFGQIGSHIAGDGAVRAKMLRAMPMAASVNMKGTDSAAPGVEEISISINGTVQF

SEQ ID NO: 1422 - protein, 234 aa, Neisseria
  VARIANT (1)...(234): Xaa = Any Amino Acid
MLRLVLAASLSAVSFPAAAEALNYNIVEFSESAGVEVAQDTMSARFQVTAEGRDKNAVNAEFVKKFNKFIRKSKNGSFKTELVSRSAMPRYQYTNGRRIQTGWEERAEFKVEGRDFDELNRFIADIQADAALXYTDFHVSRERRNEVIXQVSKDAVLRFKARAEKLAGVLGASGYKIVKLNLGHIGSHIAGGGAAQAKMLRAMPMAASVNMEGADSAAPGVEEISISVNGTVQF

SEQ ID NO: 1423 - protein, 220 aa, Neisseria
MLRSILAASLLIVEFSESAGVEAVQDTMSARFQVTAEGRDKNAVNAEFVKKFNNFTRKSKNGSFKTELVSRSAMPRYQYTNGRRIQTGWEERAEFKVEGRNFDALNRFIADVQADAALEYTDFHVSRERRNEVIDQVSKDAVLRFKARAEKLAGVLGASGYKIVKLNLGHIGSHIAGGGAAQAKMLRAMPMAASVNMEGADSAAPGVEEISISVNGTVQF

SEQ ID NO: 1424 - protein, 231 aa, Neisseria
MKLFQRIFATFCAVIVCAIFVASFSFWLVQNTLAENQFNQRRTIETTLMGSIISAFKTRGDNGAREILTEWKNSPVSSAVYVIQGDEKKDILNRYIDNYTIERARLFAANNPHSNLVRIEYDRFGEEYLFFIKGWDNHQAQRLPSPLFIPGLPLAPIWHEFIILSFIIIVGLLMAYILAGNIAKPIRILGNGMDRVAERELEDRVCQQVRDRDDELADVAMQFDTMVEKLE

SEQ ID NO: 1425 - protein, 468 aa, Neisseria
MKLFQRIFATFCAVIVCAIFVASFSFWLVQNTLAENQFNQRRTIETTLMGSIISAFRARGDAGAREILTEWKDSPVSSGVYVIQGDEKKDILNRYIDSYTIERARLFAAGHPHSNLVHIEYDRFGEEYLFFTKDWDKLQARRLPSPLLIPGLPLAPIWHELIILSFIIIVGLLMAYILAGNIAKPIRILGNGMDRVANGELETRISQQVDDRDDELSHLAIQFDKMVEKLEKLVAKERHLLHHVSHEMRSPLARMQAIVGLIQAQPQKQEQYLKRLEGELTRMDTLAGELLTLSRLETSNMALEKESLKLLPFLGNLVEDNQSIAQKNGQTVTLSADGKIPENTTILANESYLYRAFDNVIRNAVNYSPEGSTILINIGQDHKHWIIDVTDNGPGVDEMQLPHIFTAFYRADSSANKPGTGLGLALTQHIIEQHCGKIIAENIKPNGLRMRFILPKKKTGSKTEKSAN

SEQ ID NO: 1426 - protein, 468 aa, Neisseria
MKLFQRIFATFCAVIVCAIFVASFSFWLVQNTLAENQFNQRRTIETTLMGSIISAFRARGDAGAREILTEWKDSPVSSGVYVIQGDEKKDILHRYIDSYTIERARLFAAGHPHSNLVHIEYDRFGEEYLFFTKDWDKLQARRLPSPLLIPGLPLAPIWHELIILSFIIIVGLLMAYILAGNIAKPIRILGNGMDRVANGELETRISQQVDDRDDELSHLAIQFDKMVEKLEKLVAKERHLLHHVSHEMRSPLARMQAIVGLIQAQPQKQEQYLKRLEGELTRMDTLAGELLTLSRLETSNMALEKESLKLLPFLGNLVEDNQSIAQKNGQTVTLSADGKIPENTTILANESYLYRAFDNVIRNAVNYSPEGSTILINIGQDHKHWIIDVTDNGPGVDEMQLPHIFTAFYRADSSANKPGTGLGLALTQHIIEQHCGKIIAENIKPNGLRMRFILPKKKTGSKTEKSAN

SEQ ID NO: 1427 - protein, 209 aa, Neisseria
MAAHLEEQQELDNFKYFWKTTGKWLFALLILAALGYLGYTVYQNRAASQNQEAAAVLANIVEKAQNKAPQSEINAELSKLQQSYPHSISAAQATLMAAATEFDAQRYDVAEGHLKWVLSNQKDSLIQALAAQRLGVVLLQQKKYDAALAALDTPVEADFAPLLMETKGDVYAAQEKSQEALKNYGQALEKMPQDSVGRELLQMKLDSLK

SEQ ID NO: 1428 - protein, 209 aa, Neisseria
MAAHLEEQQELDNFKYFWKTTGKWLFALLILAALGYLGYTVYQNRKVSQNQEAAAVLANIVEKAQSKAPQSEINAELTKLQQSYPHSISAAQATLMAAATEFDAQRYDVAEGHLKWVLSNQKDSLIQALAAQRLGVVLLQQKKYDAALAALDTPVEADFAPLLMETKGDVYAAQGKSQEALKNYGQALEKMPQDSVGRELVQMKLDSLK

SEQ ID NO: 1429 - protein, 209 aa, Neisseria
MAAHLEEQQELDNFKYFWKTTGKWLFAVLILAALGYLGYTVYQNRAASQNQEAAAVLANIVEKAQNKAPQSEINAELAKLQQSYPHSISAAQATLMAAATEFDAQRYDVAEGHLKWVLSNQKDSLIQALAAQRLGVVLLQQKKYDAALAALDTPVEADFAPLLMETKGDVYAAQGKSQEALKNYGQALEKMPQDSVGRELVQMKLDSLK

SEQ ID NO: 1430 - protein, 180 aa, Neisseria
MKRIFLPALPAILPLSAYADLPLTIEDIMTDKGKWKLETSLTYLNSENSRAALAAPVYIQTGATSFIPIPTEIQENGSNTDMLAGTLGLRYGLTGNTDIYGSGSYLWHEERKLDGNGKTRNKRMSDISAGISHTFLKDGKNPALISFLESTVYEKSRNKASLIKKRGLCPFYNLRINYEY

SEQ ID NO: 1431 - protein, 722 aa, Neisseria
  VARIANT (1)...(722): Xaa = Any Amino Acid
GBBFFFFFLFALMKRIFLPALPAILPLSTYADLPLTIEDIMTDKGKWKLETSLTYLNSENNRAELAAPVYIQTGATSFIPIPTEIQENGSNTDMLVGTLGLRYGLTGNTDIYGSGSYLWHEERKLDGNSKTRNKRMSDVSLGISHTFLKDDKNPALISFLESTVYEKSRNKASSGKSWLIGATTYKAIDPIVLSLTAAYRINGSKTLSDGIRYKSGNYLLLNPNISFAANDRISLTGGIQWLGRQPDRTDGKRESSRNTSTYAHFGAGFGFTKTTALNASARFNVSGQCYZNRMALMHADEFALTPARAGRAPHFNTDDSEQENCECQHMHNHAHWHKSERVERDATAMHCHIRNBSEDCZZZZPGTIMESNEWRMANSYMBLARIALCRIERNEWHCFCFMKRIFLPALPAILPLSTYADLPLTIEDIMTDKGKWKLETSLTYLNSENNRHKHKHDPHPXMKRIFLPALPAILPLSTYADLPLTIEDIMTDKGKWKLETSLTYLNSENNRMHKRIFHKNRMALFHKLFKMICRSFTWRDSAADLHPWWKMNFMKRIFLPALPAILPLSTYADLPLTIEDIMTDKGKWKLETSLTYLNSENNRTITLEPIDGIDANEADDAEACBDCRTENTRYREFHYAPATABLEWRDDCMENTSMMARYINFRMATINDCMENTSMMARYINFRMFMICRSFTWRDDCMENTMSWRDDCWRDDCMENTQ

SEQ ID NO: 1432 - protein, 289 aa, Neisseria
MKRIFLPALPAILPLSAYADLPLTIEDIMTDKGKWKLETSLTYLNSENNRAELAAPVYIQTGATSFIPIPTEIQENGSNTDMLVGTLGLRYGLTGNTDIYGSGSYLWHEERKLDGNGKTRNKRMSDVSLGISHTFLKDDKNPALISFLESTVYEKSRNKASSGKSWLIGATTYKAIDPVVLSLTAAYRINGSKTLSSNTKYKAGNYWMLNPNISFAANDRISLTGGIQWLGKQPDRLDGKKESARNTSTYAHFGAGFGFTKTTALNASARFNVSGQSSSELKFGVQHTF

SEQ ID NO: 1433 - protein, 129 aa, Neisseria
MLKHLAFLLPAMMFALPAQTAVLSPYQETGCTYEGGIGKDGLPSGKGIWRCRDGRGYTGSFKNGKFDGQGVYTVAAGREVFLEPFNSDSTKFRNMALSGTFKQGLAHGRFAASQNGETLFYYEMRTRHD

SEQ ID NO: 1434 - protein, 138 aa, Neisseria
MLKHLAFLLPAMMFALPTSAAVLTSYQEPGCTYDGNVGKDGKPAGKGTWRCQDGRNYTGSFKNGKFDGQGVYTVAANREIFIEPFNSDSTKFRNMVLSGTFKKGLAHGRFTVSQNGETLFIMKCENGMIKEVKLPKNK

SEQ ID NO: 1435 - protein, 138 aa, Neisseria
MLKHLAFLLPAMMFALPAASAVLTSYQEPGCTYEGDVGKDGKPAGKGTWRCQDGRNYTGSFKNGKFDGQGVYTVAANREIFIEPFNSDSTKFRNMVLSGTFKKGLAHGRFTVSQNGETLFIMKCENGMIKEVKLPKNK

SEQ ID NO: 1436 - protein, 725 aa, Neisseria
MQQKIRFQIEAMTCQACASRIEKVLNKKDFVESAGVNFASEEAQVTFDGSKTSVADIAKIIEKTGYGAKEKTEDTLPQPEAEHHIGWRLWLLLTINIPFLIGMVGMMLKGLNWTRHDWMIPPVWQFVLASIVQLWLAIPFYKSAWASIKGGLANMDVLVTIGTVSIYLYSVYMLFFSSHAAHGMAHVYFEAGVMVIGFVSLGKFLEHRTKKSSLNSLGLLLKLTPTQVNVQRNGEWKQLPIDQVQIGDLIRTNHGERIAADGIIESGSGWADESHLTGESNPEEKKAGGKVLAGALMTEGSVVYRAAQLGSQTLLGDMMNALSEAQGSKAPIARVADKAAAVFVPTVVGIALLTFIVAWLIKGDWTVALMHAVAVLVIACPCALGLATPAAIMVGMGKAVKHGIWFKDAAAMEEAAHVDAVVLDKTGTLTEGRPQVAAVYYVPDSGFDEDALYRIAAAVEQNAAHPLARAIVSAAQARGLEIPAAQNAQTVVGAGITAEVEGVGLVKSGKAEFAELTLPKFSDGVWEIASAVTVSVNGKPIGAFALSDALKADTAEAIGRLKKHNIDVYIMSGDNQSTVEYVAKQLGIAHAFGNMSPCDKAAEVQKLKAAGKTVAMVGDGINDAPALAAANVSFAMKGGADVAEHTASATLMQHSVNQLADALLISQATLENIKQNLFFAFFYNILGIPLAALGFLNPVIAGAAMAASSVSVLGNALRLKWVKID

SEQ ID NO: 1437 - protein, 720 aa, Neisseria
MQQKIRFQIEGMTCQACASRIEKVLNKKDFVESAGVNFASEEAQVVFDDSKTSVADIAKIIEKTGYGAKEKTEDTLPQPEAEHHIGWRLWLLFTINVPFLIGMAGMMIGRHDWMIPPLWQFALASVVQLWLAIPFYKSAWASIKGGLANMDVLVTIGTVSIYLYSVYMLFFSPHAAYGMAHVYFEVGVMVIGFVSLGKFLEHRTKKSSLNSLGLLLKLTPTQVNVQRNGEWKQLPIDQVQIGDLIRANHGERIAADGIIESGSGWADESHLTGESNPEEKKAGGKVLAGALMTEGSVVYRATQLGSQTQLGDMMNALSEAQGSKAPIARVADKAAAVFVPAVVGIALLTFIVTWLIKGDWTVALMHAVAVLVIACPCALGLATPAAIMVGMGKAVKHGIWFKDAAAMEEAAHVDAVVLDKTGTLTEGSPQVAAVYCVPDSGFDEDALYRIAAAVEQNAAHPLARAIVSAAQARGLDIPAAQNAQTVVGAGITAEVEGVGLVKAGKAEFAELALPKFLDGVWDIASIVAVSVDNKPIGAFALADALKADTAEAIGRLKKHNIDVYIMSGDNQGTVEYVAKQLGIAHAFGNMSPRDKAAEVQKLKAAGKTVAMVGDGINDAPALAAANVSFAMKGGADVAEHTASATLMQHSVNQLADALLVSQATLKNIKQNLFFAFFYNILGIPLAALGFLNPVIAGAAMAASSVSVLSNALRLKRVKID

SEQ ID NO: 1438 - protein, 725 aa, Neisseria
MQQKVRFQIEGMTCQACASRIEKVLNKKDFVESAGVNFASEEAQVVFDDSKTSVADIAKIIEKTGYGAKEKTEDTLPQPEAEHHIGWRLWLLLAINIPFLIGMVGMMLKGLNWTRHDWMLSPLLQFALASVVQLWLAVPFYKSAWASIKGGLANMDVLVTIGTVSIYLYSVYMLFFSPHAAYGMAHVYFEVGIMVIGFVSLGKFLEHRTKKSSLNSLGLLLKLTPTQVNVQRDGEWRQLPIDQVQIGDLIRANHGERIAADGIIESGSGWADESHLTGESNPEEKKAGGKVLAGALMTEGSVVYRAAQLGSQTLLGDMMNALSEAQGSKAPIARVADKAAAVFVPAVVGIALLTFIATWLIKGDWTLALMHAVAVLVIACPCALGLATPAAIMVGMGKAVKHGIWFKDAAAMEEAAHVDAVVLDKTGTLTEGKPQVAAVYCVPDSGFDEDALYRIAAAVEQNAAHPLARAIVSAAQARGLEIPTAQNAQTIVGAGITAEVKGAGLVKAGKAEFAELTLPKFSDGVWEIASVVAVSVNGKPIGAFALADALKADTAEAIGRLKKHNIDVYIMSGDNQGTVEYVAKQLGIAHAFGNMSPRDKAAEVQKLKAAGKTVAMVGDGINDAPALAAANVSFAMKGGADVAEHTASATLMQHSVNQLADALSVSRATLKNIKQNLFFAFFYNILGIPLAALGFLNPVIAGAAMAASSVSVLSNALRLKRVKID

SEQ ID NO: 1439 - protein, 516 aa, Neisseria
MKKPLISVAAVLLGVALGTPYYLGVKAEESLTQQQKILQKTGFLTVESHQYDRGWFTSTETTVIRLKPELLHNAQKYLPDNLKIVLEQPVTLVNHITHGPFAGGFGTQAHIETEFKYAPETEKVLERFFGKQVPVSLANTVYFNGSGKMEVSVPAFDYEELSGIRLHWEGLTGETVYQKGFKSYRNSYDAPLFKIKLADKGDAAFEKAHFDSETSDGINPLALGSSNLTLEKFSLEWKEGVDYNVKLNELVNLVTDLQIGAFINPNGSIAPSKIEVGKLAFSTKTGESGAFIDSEGRFRFDTLVYGDEKYGPLDIHIAAEHLDASALTVLKRKFAQISAKKMTEEQIRNDLIAAVKGDASGLFTHDPVLNIKIFRFTLPQGKIDVGGKIMFKGMKKEDLNQLGLMLKKTEANIRMSIPQKMLEDLAVSQAGNIFSVNAEDEAEARASIADINETLRLMVDSTVQSMAREKYLTLDGNQIDTVISLKNNALKLNGKTLQNEPDPDFDEGDMVSGQPH

SEQ ID NO: 1440 - protein, 462 aa, Neisseria
  VARIANT (1)...(462): Xaa = Any Amino Acid
WFTSMETTVIRLKPELLNNARKYLPDNLKTVLEQPVTLVNHITHGPFAGGFGTQAYIETEFKYAPETEKVLERFFGKQVPASLANTVYFNGSGKMEVSVPAFDYEELSGIXLHWEXLTGETVYQKGFKSYRNGYDAPLFKIKLADKGDAAFEKVHFDSETSDGINPLALGSSNLTLEKFSLEWKEGVDYNVKLNELVNLVTDLQIGAFINPNGSIAPSKIEVGKLAFSTKTGESGAFINSEGQFRFDTLVYGDEKYGPLDIHIAAEHLDASALTVLKRKFAQISAKKMTEEQIRNDLIAAVKGEASGLFTNNPVLDIKTFRFTLPSGKIDVGGKIMFKDMKKEDLNQLGLMLKKTEADIRMSIPQKMLEDLAVSQAGNIFSVNAEDEAEGRASLDDINETLRLMVDSTVQSMAREKYLTLNGDQIDTAISLKNNQLKLNGKTLQNEPEPDFDEGGMVSEPQQ

SEQ ID NO: 1441 - protein, 516 aa, Neisseria
MKKPLISVAAALLGVALGTPYYLGVKAEESLTQQQKILQEAGFLTVESHQYERGWFTSTETTVIRLKPELLHNAQKYLPDNLKTVLEQPVTLVNHITHGPFAGGFGTQAYIETEFKYAPETEKVLERFFGKQVPVSLANTVYFNGSGKMEVSVPAFDYEELSGIRLHWEGLTGETVYQKGFKSYRNGYDAPLFKIKLADKGDAAFEKVHFDSETSDGINPLALGSSNLTLEKFSLEWKEGVDYNVKLNELVNLVTDLQIGAFINPNGSIAPSKIEVGKLAFSTKTGESGAFIDSEGQFRFGTLVYGDEKYGPLDIHIAAEHLDASALTVLKRKFARISAKKMTEEQIRNDLIAAVKGEASGLFTHNPVLDIKTFRFTLPSGKIDVGGKIMFKDMKKEDLNQLGLMLKKTEADIRMSIPQKMLEDLAVSQAGNIFSVNAEDEAEGRASLDDINETLRLMVDSTVQSMAREKYLTLNGDQIDTAISLKNNQLKLNGKTLQNEPEPDFDEGGMVSEPQQ

SEQ ID NO: 1442 - protein, 516 aa, Neisseria
MKKPLISVAAALLGVALGTPYYLGVKAEESLTQQQKILQETGFLTVESHQYERGWFTSMETTVIRLKPELLNNARKYLPDNLKTVLEQPVTLVNHITHGPFAGGFGTQAYIETEFKYAPETEKVLERFFGKQVPASLANTVYFNGSGKMEVSVPAFDYEELSGIRLHWEGLTGETVYQKGFKSYRNGYDAPLFKIKLADKGDAAFEKVHFDSETSDGINPLALGSSNLTLEKFSLEWKEGVDYNVKLNELVNLVTDLQIGAFINPNGSIAPSKIEVGKLAFSTKTGESGAFINSEGQFRFDTLVYGDEKYGPLDIHIAAEHLDASALTVLKRKFAQISAKKMTEEQIRNDLIAAVKGEASGLFTNNPVLDIKTFRFTLPSGKIDVGGKIMFKDMKKEDLNQLGLMLKKTEADIRMSIPQKMLEDLAVSQAGNIFSVNAEDEAEGRASLDDINETLRLMVDSTVQSMAREKYLTLNGDQIDTAISLKNNQLKLNGKTLQNEPEPDFDEGGMVSEPQQ

SEQ ID NO: 1443 - protein, 446 aa, Neisseria
LQTLLAFIFAILILVSLHEFGHYIVARLCGVKVVRFSVGFGKPFFTRKRGDTEWCLAPIPLGGYVKMVDTREGEVSEADLPYAFDKQHPAKRIAIVAAGPLTNLALAVLLYGLSFSFGVTELRPYVGTVEPDTVAARTGFQSGDKIQSVNGVSVQDWSSAQTEIVLNLEAGKVAVGVQTASGAQTVRTIDAAGTPEAGKIAKNQGYIGLMPFKITTVAGGVEKGSPAEKAGLKPGDRLTAADGKPIASWQEWANLTRQSPGKKITLTYERAGQTHTADIRPDTVEQPDHTLIGRVGLRPQPDRAWDAQIRRSYRPSVVRAFGMGWEKTVSHSWTTLKFFGKLISGNASVSHISGPLTIADIAGQSAELGLQSYLEFLALVSISLGVLNLLPVPVLDGGHLVFYTVEWIRGKPLGERVQNIGLRFGLALMMLMMAAAFFNDVTRLIG

SEQ ID NO: 1444 - protein, 446 aa, Neisseria
LHTLLAFIFAILILVSLHEFGHYIVARLCGVKVVRFSVGFGKPFFTRKRGDTEWCLAPIPLGGYVKMVDTREGEVSEADLPYAFDKQHPAKRIAIVAAGPLTNLALAVLLYGLSFSFGVTELRPYVGTVEPDTIAARAGFQSGDKIQSVNGTPVADWGSAQTEIVLNLEAGKVAVGVQTASGAQTVRTIDAAGTPEAGKIAKNQGYIGLMPFKITTVAGGVEKGSPAEKAGLKPGDRLTAADGKPIASWQEWANLTRQSPGKKITLNYERAGQTHTADIRPDTVEQSDHTLIGRVGLRPQPDRAWDAQIRRSYRPSVVRAFGMGWEKTVSHSWTTLKFFGKLISGNASVSHISGPLTIADIAGQSAELGLQSYLEFLALVSISLGVLNLLPVPVLDGGHLVFYTAEWIRGKPLGERVQNIGLRFGLALMMLMMAVAFFNDVTRLLG

SEQ ID NO: 1445 - protein, 446 aa, Neisseria
LHTLLAFIFAILILVSLHEFGHYIVARLCGVKVVRFSVGFGKPFFTRKRGDTEWCLAPIPLGGYVKMVDTREGEVSEADLPYAFDKQHPAKRIAIVAAGPLTNLALAVLLYGLSFSFGVTELRPYVGTVEPDTIAARAGFQSGDKIQSVNGTPVADWGSAQTEIVLNLEAGKVAVGVQTASGAQTVRTIDAAGTPEAGKIAKNQGYIGLMPFKITTVAGGVEKGSPAEKAGLKPGDRLTAADGKPIASWQEWANLTRQSPGKKITLTYERAGQTHTADIRPDTVEQPDHTLIGRVGLRPQPDRAWDAQIRRSYRPSVVRAFGMGWEKTVSHSWTTLKFFGKLISGNASVSHISGPLTIADIAGQSAELGLQSYLEFLALVSISLGVLNLLPVPVLDGGHLVFYTAEWIRGKPLGERVQNIGLRFGLALMMLMMAVAFFNDVTRLLG

SEQ ID NO: 1446 - protein, 237 aa, Neisseria
MIPDVFGQIFSGAFKFDAAAGGLLGGLISQTMMMGIKRGLYSNEAGMGSAPNAAAAAEVKHPVSQGMIQMLGVFVDTIIVCSCTAFIILIYQQPYGDLSGAALTQAAIVSQVGQWGAGFLAVILFMFAFSTVIGNYAYAESNVQFIKSHWLITAVFRMLVLAWVYFGAVANVPLVWDMADMAMGIMAWINLVAILLLSPLAFMLLRDYTAKLKMGKDPEFKLSEHPGLKRRIKSDVW

SEQ ID NO: 1447 - protein, 237 aa, Neisseria; identical to SEQ ID NO: 1446

SEQ ID NO: 1448 - protein, 237 aa, Neisseria; identical to SEQ ID NO: 1446

SEQ ID NO: 1449 - protein, 313 aa, Neisseria
MLELNGLCKCFGGKTVADNICLTVGRGKILAVLGRSGCGKSTLLNMIAGIVRPDGGEIRLNGENITCMPPEKRRISLMFQDYALFPHMSALENTAFGLKMQKMPKAEAERLALSALAEVGLENEAHRKPEKLSGGEKQRLALARALVVRPSLLLLDESFSSLDTHLRDRLRRMTAERIRKGGIPAVLVTHSPEEACTAADEIAVMHEGKILQCGTPETLIQTPAGVQVARLMGLPNTDDDRHIPQNAVCLDNHGTECRLLSLVRLPDSLRLSAVHPEHGELTLNLTVGQHTDGISGNGTVRIRVDEGRIVRFR

SEQ ID NO: 1450 - protein, 312 aa, Neisseria
MLELNGLCKRFGNKTVADNICLTVGRGKILAVLGRSGCGKSTLLNIIAGIVRPDGGEIWLNGENITRMPPEKRRISLMFQDYALFPHMSALENAAFGLKMQKMPKAEAERLAMAALAEVGLENEAHRKPEKLSGGEKQRLALARALVVRPSLLLLDESFSSLDTHLRGTLRRMTAERIRNGGIPAVLVTHSPEEACTTADEIAVMHKGRILQYGTPETLVKTPSCVQVARLMGLPNTDDNRHIPQHAVRFDQDGMECRVLSRTCLPESFSLSVLHPEHGILWLNLDMRHAGAVSGKDTVRIHIEEREIVRFR

SEQ ID NO: 1451 - protein, 312 aa, Neisseria
  VARIANT (1)...(312): Xaa = Any Amino Acid
MLELNGLCKRFGGKTVADDICLTVGRGKILAVLGRSGCGKSTLLNMIAGIVRPDGGEIWLNGENITRMPPEKRRISLMFQDYALFPHMSALENAAFGLKMQKMPKAEAESLAMAALAEVGLENEAHRKPXKLSGGEKQRLALARALVVRPSLLLLDESFSSLDTHLRDRLRRMTAERIRKGGIPAVLVTHSPEEACTAADEIAVMHEGKILQCGTPETLVQTPAGVQVAHLMGLPNTDDDRHIPQHAVRFDQDGMECRVLSRTCLPESFSLSVLHPEHGILWLNLDMPHAGEISGNDTVRIHIEDREIVRFR

SEQ ID NO: 1452 - protein, 158 aa, Neisseria
MGADTDGDKDVRLNRTGLVFSILRLLFRIGIGIGKFAVQAFQVFKLLICTVEHPNRFALPLGGQQLTRFDFTDIHLDGSTGGLGFFRREKTGHKRRCHTQCCHSARAAGRKCQETAAAVVDFLIIHYSVVLIFWECRAIKHCNFTQFAVILKALFKIR

SEQ ID NO: 1453 - protein, 158 aa, Neisseria
MGADTDGDKDVRLNRTGLVFSILRLLFRIGIGIGKFAVQAFQVFKLLICTVEHPNRFALPLGGQQLTRFDFTDIHLDGSTGGLGFFRREKTGHKRRCHTQCCHSARAAGRECQETAAAVVDFLIIHYSVVLIFWEYRAIKRCNFTQFAVILKALFKIR

SEQ ID NO: 1454 - protein, 158 aa, Neisseria; identical to SEQ ID NO: 1453

SEQ ID NO: 1455 - protein, 388 aa, Neisseria
MRKFNLTALSVMLALGLTACQPPEAEKAAPAASGETQSANEGGSVGIAVNDNACEPMNLTVPSGQVVFNIKNNSGRKLEWEILKGVMVVDERENIAPGLSDKMNRNLLPGEYEMTCGLLTNPRGKLVVADSGFKDTANEADLEKLPQPLADYKAYVQGEVKELAAKTKTFTEAVKAGDIEKAKSLFAATRVHYERIEPIAELFSELDPVIDACEDDFKDGAKDAGFTGFHRIEHALWVEKDVSGVKETAAKLMTDVEALQKEIDALAFPPGKVVGGASELIEEAAGSKISGEEDRYSHTDLSDFQANADGSKKIVDLFRPLIEAKNKALLEKTDTNFKQVNEILAKYRTKDGFETYDKLSEADRKALQAPINALAEDLAQLRGILGLK

SEQ ID NO: 1456 - protein, 388 aa, Neisseria
MRKFNLTALSVMLALGLTACQPPEAEKAAPAASGEAQTANEGGSVSIAVNDNACEPMELTVPSGQVVFNIKNNSGRKLEWEILKGVMVVDERENIAPGLSDKMTVTLLPGEYEMTCGLLTNPRGKLVVTDSGFKDTANEADLEKLSQPLADYKAYVQGEVKELVAKTKTFTEAVKAGDIEKAKSLFADTRVHYERIEPIAELFSELDPVIDAREDDFKDGAKDAGFTGFHRIEYALWVEKDVSGVKEIAAKLMTDVEALQKEIDALAFPPGKVVGGASELIEEVAGSKISGEEDRYSHTDLSDFQANVDGSKKIVDLFRPLIEAKNKALLEKTDTNFKQVNEILAKYRTKDGFETYDKLGEADRKALQASINALAEDLAQLRGILGLK

SEQ ID NO: 1457 - protein, 388 aa, Neisseria
MRKFNLTALSVMLALGLTACQPPEAEKAAPAASGEAQTANEGGSVSIAVNDNACEPMELTVPSGQVVFNIKNNSGRKLEWEILKGVMVVDERENIAPGLSDKMTVTLLPGEYEMTCGLLTNPRGKLVVTDSGFKDTANEADLEKLSQPLADYKAYVQGEVKELVAKTKTFTEAVKAGDIEKAKSLFADTRVHYERIEPIAELFSELDPVIDAREDDFKDGAKDAGFTGFHRIEYALWVEKDVSGVKEIAAKLMTDVEALQKEIDALAFPPGKVVGGASELIEEVAGSKISGEEDRYSHTDLSDFQANVDGSKKIVDLFRPLIETKNKALLEKTDTNFKQVNEILAKYRTKDGFETYDKLGEADRKALQASINALAEDLAQLRGILGLK

SEQ ID NO: 1458 - protein, 373 aa, Neisseria
MLLLDEPTNHLDAESVEWLEQFLVRFPGTVVAVTHDRYFLDNAAEWILELDRGHGIPWKGNYSSWLEQKEKRLENEAKSEAARVKAMKQELEWVRQNAKGRQAKPKARLARFEEMSNYEYQKRNETQEIFIPVAERLGNEVIEFVNVSKSFGDKVLIDGLSFKVPAGAIVGIIGPNGAGKSTLFKMIAGKEQPDSGEVKIGQTVKMSLIDQSREGLQNDKTVFDNIAEGRDILQVGQFEIPARQYLGRFNFKGSDQSKIARQLSGGERGRLHLAKTLLGGGNVLLLDEPSNDLDVETLRALEDALLEFAGSVMVISHDRWFLDRIATHILACEGDSKWVFFDGNYQEYEADKKRRLGKEGAKPKRIKYKPVTR

SEQ ID NO: 1459 - protein, 558 aa, Neisseria
MSQQYVYSMLRVSKVVPPQKTIIKDISLSFFPGAKIGLLGLNGAGKSTVLRIMAGVDKEFEGEAVPMGGIKIGYLPQEPELDPEKTVREEVESGLGEVAAAQKRLEEVYAEYANPDADFDALAEEQGRLEAIIAAGSSTGGGAEHELEIAADALRLPEWDAKIDNLSGGEKRRVALCKLLLSKPDMLLLDEPTNHLDAESVEWLEQFLVRFPGTVVAVTHDRYFLDNAAEWILELDRGHGIPWKGNYSSWLEQKEKRLENEAKSEAARVKAMKQELEWVRQNAKGRQAKSKARLARFEEMSNYEYQKRNETQEIFIPVAERLGNEVIEFVNVSKSFGDKVLIDDLSFKVPAGAIVGIIGPNGAGKSTLFKMISGKEQPDSGEVKIGQTVKMSLIDQSREGLQNDKTVFDNIAEGRDILQVGQFEIPARQYLGRFNFKGSDQSKIAGQLSGGERGRLHLAKTLLSGGNVLLLDEPSNDLDVETLRALEDALLEFAGSVMVISHDRWFLDRIATHILACEGDSKWVFFDGNYQEYEADKKRRLGEEGAKPKRIKYKPVTR

SEQ ID NO: 1460 - protein, 558 aa, Neisseria
MSQQYVYSMLRVSKVVPPQKTIIKDISLSFFPGAKIGLLGLNGAGKSTVLRIMAGVDKEFEGEAVPMGGIKIGYLPQEPELDPEKTVREEVESGLGEVAAAQKRLEEVYAEYANPDADFDALAEEQGRLEAIIAAGSSTGGGAEHELEIAADALRLPEWDAKIDNLSGGEKRRVALCKLLLSKPDMLLLDEPTNHLDAESVEWLEQFLVRFPGTVVAVTHDRYFLDNAAEWILELDRGHGIPWKGNYSSWLEQKEKRLENEAKSEAARVKAMKQELEWVRQNAKGRQAKSKARLARFEEMSNYEYQKRNETQEIFIPVAERLGNEVIEFVNVSKSFGDKVLIDDLSFKVPAGAIVGIIGPNGAGKSTLFKMIAGKEQPDSGEVKIGQTVKMSLIDQSREGLQNDKTVFDNIAEGRDILQVGQFEIPARQYLGRFNFKGSDQSKITGQLSGGERGRLHLAKTLLGGGNVLLLDEPSNDLDVETLRALEDALLEFAGSVMVISHDRWFLDRIATHILACEGDSKWVFFDGNYQEYEADKKRRLGEEGTKPKRIKYKPVTR

SEQ ID NO: 1461 - protein, 389 aa, Neisseria
MLLHVSNSLKQLQEERIRQERIRQERIRQARGNLASVNRKQREAWDKFQKLNTELNRLKTEVAATKAQISRFVSGNYKNSRPNAVALFLKNAEPGQKNRFLRYTRYVNASNREVVKDLEKQQKALAVQEQKINNELARLKKIQANVQSLLKKQGVTDAAEQTESRRQNAKISKDARKLLEQKGNEQQLNKLLSNLEKKKAEHRIQDAEAKRKLAEAKLAAAEKARKEAAQQKAEARRAEMSNLTAEDRNIQAPSVMGIGSADGFSRMQGRLKKPVDGVPTGLFGQNRSGGDVWKGVFYSTAPATVESIAPGTVSYADELDGYGKVVVIDHGENYISIYAGLSEISAGKGYTVAAGSKIGTSGSLPDGEEGLYLQIRYRGQVLNPSGWIR

SEQ ID NO: 1462 - protein, 384 aa, Neisseria
MLLHVSNSLKQLQEERIRQERIRQARGNLASVNRKQREAWDKFQKLNTELNRLKTEVAATKAQISRFVSGNYKNSQPNAVALFLKNAEPGQKNRFLRYTRYVNASNREVVKDLEKQQKALAVQEQKINNELARLKKIQANVQSLLKKQGVTDAAEQTESRRQNAKIAKDARKLLEQKGNEQQLNKLLSNLEKKKAEHRIQDAEAKRKLAEARLAAAEKARKEAAQQKAEARRAEMSNLTAEDRNIQAPSVMGIGSADGFSRMQGRLKKPVDGVPTGLFGQNRSGGDIWKGVFYSTAPATVESIAPGTVSYADELDGYGKVVVVDHGENYISIYAGLSEISVGKGYMVAAGSKIGSSGSLPDGEEGLYLQIRYQGQVLNPSSWIR

SEQ ID NO: 1463 - protein, 389 aa, Neisseria
MLLHVSNSLKQLQEERIRQERIRQERIRQARGNLASVNRKQREAWDKFQKLNTELNRLKTEVAATKAQISRFVSGNYKNSQPNAVALFLKNAEPGQKNRFLRYTRYVNASNREVVKDLEKQQKALAVQEQKINNELARLKKIQANVQSLLKKQGVTDAAEQTESRRQNAKIAKDARKLLEQKGNEQQLNKLLSNLEKKKAEHRIQDAEAKRKLAEARLAAAEKARKEAAQQKAEARRAEMSNLTAEDRNIQAPSVMGIGSADGFSRMQGRLKKPVDGVPTGLFGQNRSGGDVWKGVFYSTAPATVESIAPGTVSYADELDGYGKVVVVDHGENYISIYAGLSEISVGKGYMVAAGSKIGSSGSLPDGEEGLYLQIRYQGQVLNPSSWIR

SEQ ID NO: 1464 - protein, 203 aa, Neisseria
MFPTGNLVDEIDVPNIGRLKATLINAGIPTVFLNAADLGYTGKELQDDINNDAAALEKFETIRAYGALKMGLISDVSEAAARARTPKPAFVAPAADYTASSGKTVNAADIDLPVRALSMGKLHHAMMGIASVAIAAAVLGTLVNLAAGGGTRKEVRFGHPSGTLRVGAAAECQDGQWTAAKAVMSRSARVIMESWVRVPDDCF

SEQ ID NO: 1465 - protein, 205 aa, Neisseria
MFPTGNLVDEIDVPNIGRLKATLINAGIPTVFLNAADLGYTGKELQDDINNDAAALEKFEKIRAYGALKMGLISDVSEAAARAHTPKVAFVAPAADYTASSGKTVNAADIDLLVRALSMGKLHHAMMGTASVAIATAAAVPGTLVNLAAGGGTRKEVRFGHPSGTLRVGAAAECQDGQWTATKAVMSRSARVMMEGWVRVPEDCF

SEQ ID NO: 1466 - protein, 205 aa, Neisseria; identical to SEQ ID NO: 1465

SEQ ID NO: 1467 - protein, 115 aa, Neisseria
MLLHQCDKARHMRPFLLGGQINRHRQASNRGLCSFGGFQGNREAQVFNADLIDRQVAQISAGLHVCNGVHALFVLNIQIIIEMCVLYGRQMPSEKTLSAACLQMRDYITCFWRLH

SEQ ID NO: 1468 - protein, 110 aa, Neisseria
MLLHQCDKTRHMRPLLLSRQVNRHGQTGNGGLDAFCSLQGNRKAQVFDTDLIDRQIAQISAGLHVCNSVHELFFLNIHVIVEMCAWYGVSAGEYTVNLQMRDYITRFQLH

SEQ ID NO: 1469 - protein, 110 aa, Neisseria
MLLHQCDKARHMRTLLLGRQVNRHGQTGNCGLDAFCSLQGNRKAQVFDTDLIDRQIAQISAGLHVCNSVHELFFLNIHVIVEMCAWYGVSTGEYTVNLQMRDYITRFQLH

SEQ ID NO: 1470 - protein, 449 aa, Neisseria
MDSRLRGNDARKYGIRFAQRGRLKHTPPNAHPFSDGPAPKKQPQTTRRNIMSDQLILVLNCVSSSLKGAVIDRKSGSVVLSCLGERLTTPEAVITFNKDGNKRQVPLSGRNCHAGAVGMLLNELEKHGLHDRIKAIGRRIAHGGEKYHESVLIDQDVLDELKACIPFAPLHNPANISGILAAQEHFPGLPNVGVMDTSFHQTMPERAYTYAVPRELRKKYAFRRYGFHGTGMRYVAPEAARILGKPLEDIRMIIAHLGNGASITAVKNGKSVDTGMGFTPIEGLVMGTRCGDTDPGVYSYPTFHAGMDVAQVDEMLNEKSGFPGISELPNDCRTLEIAADEGREGARLALEVMTCRLAKYIASMAVACGSVDALVFTGGIGENSRNIRAKTVSYLDFLGLHIDTKANMEKRYGNSGIISPTDSSPAVLVVPTNEELMIACDTAELAGIL

SEQ ID NO: 1471 - protein, 450 aa, Neisseria
  VARIANT (1)...(450): Xaa = Any Amino Acid
LSSRRRGRNNDRKCGIRFAQRGRLKHLAPDVCXFSDDPTLKKQPQTTRRNIMSDQLILVLNCGSSSLKGAVIDRXSGSVVLSCLGERLTTPEAVITFNKDGNKRQVPLSGRNCHAGAVGMLLNELEKHGLHDRIKAIGHRIAHGGEKYSESVLIDQAVMDELNACIPLAPLHNPANISGILAAQEHFPGLPNVGVMDTSFHQTMPERAYTYAVPRELRKKYAFRRYGFHGTSMRYVAPEAARILGKPLEDIRMIIAHLGNGASITAIKNGKSVDTSMGFTPIEGLVMGTRCGDIDPGVYSYLTSHAGMDVAQVDEMLNKKSGLLGISELSNDCRTLEIAADEGHEGARLALEVMTYRLAKYIASMAVGCGGVDALVFTGGIGENSRNIRAKTVSYLDFLGLHIDTKANMEKRYGNSGIISPTDSSPAVLVVPTNEELMIACDTAELAGIL

SEQ ID NO: 1472 - protein, 450 aa, Neisseria
  VARIANT (1)...(450): Xaa = Any Amino Acid
LSSRRRGRNNDRKCGIRFAQRGRLKHTPPNAHPFSDDPTXKKQPQTTRRNIMSDQLILVLNCGSSSLKGAVIDRKSGSVVLSCLGERLTTPEAVITFSKDGNKRQVPLSGRNCHAGAVGMLLNELEKHELHDRIQAVGHRIAHGGEKYSESVLIDQAVMDELNACIPLAPLHNPANISGILAAQEHFPGLPNVGVMDTSFHQTMPERAYTYAVPRELRKKYAFRRYGFHGTSMRYVAPEAACILGKPLEDIRMIIAHLGNGASITAIKNGKSVDTSMGFTPIEGLVMGTRCGDIDPGVYSYLTSHAGLDVAQVDEMLNKKSGLLGISELSNDCRTLEIAADEGHEGARLALEVMTYRLAKYIASMAVGCGGVDALVFTGGIGENSRNIRAKTVSYLDFLGLHIDTKANMEKRYGNSGIISPTDSSPAVLVVPTNEELMIACDTAELVGIL

SEQ ID NO: 1473 - protein, 167 aa, Neisseria
MPEAHFFTRSAACGKVDQRTEHGGGDGDRGDAHHSVVQFAHAQGAYRQIDVGGVYGFAAGGGVIGGGRDEGGFRRARAGGGFGYVADQTHFQRAICADGFKFFQRGGIVVDVVLQLFARVAQVGGVQENGRNARVDERGFQTTYIRHINFVDQIAGWEHTAFAVGWI

SEQ ID NO: 1474 - protein, 169 aa, Neisseria
MPEAHFFTRSAACGKVDQRTGYGGGGRNGNRGGTHHRVVQFAHAQGAYQQIDVGGVHGFATGGGVIGGGRDEGDFRRVRASGSFGYVADQTHFQRTVSADFLEFFQSRGIVVDVVLQLFACVAQVGGIQENGRNARVDERGFQTAYIRHINFIDQIAGWEHTAFAVGWI

SEQ ID NO: 1475 - protein, 220 aa, Neisseria
MPEAHFFTRSAACGKVDQRTGHGGGGRNGNRGGTHHRVVQFAHAQGAYQQIDVGGIHGFATGGGVIGGGRDEGDFRRVRAGGSFGYVADQTHFQRTVSADFLEFFQSCGIVVDVVLQLFARVAQVGGIQENGRNARVDERGFQTAYIRHINFIDQIAGWEHTAFAVGWIKKFDLYFGCRERYAVELKIACFQNCAVLHRYMGNNGFADVFLPDFDCADAV

SEQ ID NO: 1476 - protein, 514 aa, Neisseria
MMTEMQQRAQLHRQIWKIADEVRGAVDGWDFKQYVLGTLFYRFISENFTDYMQAGDSSIDYAAMPDSIITPEIKDDAVKVKGYFIYPGQLFCNIAAEAHQNEELNTKLKEIFTAIESSASGYPSEQGIKGLFDDFDTTSSRLGSTVADKNKRLAAVLKGVAELDFGNFEDHRIDLFGDAYEYLISNYAANAGKSGGEFFTPQSVSKLIARLAVHGQEKVNKIYDPACGSGSLLLQAKKQFDEHIIEEGFFGQEINHTTYNLARMNMFLHNVNYNKFHIELGDTLTNPKLKDSKPFDAVVSNPPYSIDWIGSDDPTLINDDRFAPAGVLAPKSKADFAFILHALNYLSGRGRAAIVSFPGIFYRGGAEQKIRQYLVEGNYVETVIALAPNLFYGTCIAVNILVLSKHKDNTDIQFIDASGFFKKETNNNVLTEEHIAEIVKLFADKADVPHIAQNAAQQTVKDNGYNLAVSSYVEAEDTREVIDIRQLNAEISETVAKIERLRREIDEVIAEIET

SEQ ID NO: 1477 - protein, 514 aa, Neisseria
MMTEMQQRAQLHRQIWKIADEVRGAVDGWDFKQYVLGTLFYRFISENFTDYMQAGDSSIDYAAMPDSIITPEIKDDAVKVKGYFIYPGQLFCNIAAEAHQNEELNTKLKEIFTAIESSASGYPSEQDIKGLFDDFDTTSSRLGSTVADKNKRLAAVLKGVAELDFGNFENHHIDLFGDAYEYLISNYAANAGKSGGEFFTPQSVSKLIARLAVHGQEKVNKIYDPACGSGSLLLQAKKQFDEHIIEEGFFGQEINHTTYNLARMNMFLHNVNYNQFHIELGDTLTNPKLKDSKPFDAIVSNPPYSINWIGSDDPTLINDDRFAPAGVLAPKSKADFAFILHALNYLSGRGRAAIVSFPGIFYRGGAEQKIRQYLVEGNYVETVIALAPNLFYGTGIAVNILVLSKHKDNTDIQFIDASGFFKKETNNNVLIEEHIAEIVKLFADKADVPHIAQNAAQQTVKDNGYNLAVSSYVEAEDTREIIDIKQLNAEIGETVAKIERLRREIDEVIAEIEA

SEQ ID NO: 1478 - protein, 514 aa, Neisseria
MMTEIQQRAQLHRQIWKIADEVRGAVDGWDFKQYVLGTLFYRFISENFTDYMQAGDSSIDYAAMPDSIITPEIKDDAVKVKGYFIYPGQLFCNIAAEAHQNEELNTKLKEIFTAIESSASGYPSEQDIKGLFDDFDTTSSRLGSTVADKNKRLAAVLKGVAELDFGSFEDHHIDLFGDAYEYLISNYAANAGKSGGEFFTPQSVSKLIARLAVHGQEKVNKIYDPACGSGSLLLQAKKQFDEHIIEEGFFGQEINHTTYNLARMNMFLHNVNYNKFHIELGDTLTNPKLKDSKPFDAVVSNPPYSINWIGSGDPTLINDDRFAPAGVLAPKSKADFAFILHALNYLSGRGRAAIVSFPGIFYRGGAEQKIRQYLVEGNYVETVIALAPNLFYGTGIAVNILVLSKHKDNTDIQFIDAGGFFKKETNNNVLTEEHIAEIVKLFADKADVPHIAQNAAQQTVKDNGYNLAVSSYVEPEDTREIIDIKQLNAEISETVAKIERLRREIDEVIAEIEA

SEQ ID NO: 1479 - protein, 226 aa, Neisseria
MSKFIAKQSVGAEVIDTPRTEEEAWLLNTVEAQARQWNLKTPEVAIYHSPEPNAFATGASRNSSLIAVSTGLLDHMTRDEVEAVLAHEMAHVGNGDMVTLTLIQGVVNTFVVFLSRIIANLIARNNDGSQSQGTYFLVSMVFQILFGFLASLIVMWFSRQREYRADAGAAKLVGAPKMISALQRLKGNPVDLPEEMNAMGIAGDTRDSLLSTHPSLDNRIARLKSL

SEQ ID NO: 1480 - protein, 226 aa, Neisseria; identical to SEQ ID NO: 1479

SEQ ID NO: 1481 - protein, 226 aa, Neisseria; identical to SEQ ID NO: 1479

SEQ ID NO: 1482 - protein, 459 aa, Neisseria
MLLDLDRFSFSVFLKEIRLLTALALPMLLAQVAQVGIGFVDTVMAGGAGKEDLAAVALGSSAFATVYITFMGIMAALNPMIAQLYGAGKTGEAGETGRQGIWFGLILGIFGMILMWAAITPFRNWLTLSDYVEGTMAQYMLFTSLAMPAAMVHRALHAYASSLNRPRLIMLVSFAAFVLNVPLNYIFVYGKFGMPALGGAGCGVATMAVFWFSALALWIYIAKEKFFRPFGLTAKFGKPDWAVFKQIWKIGAPIGLSYFLEASAFSFIVFLIAPFGEDYVAAQQVGISLSGILYMIPQSVGSAGTVRIGFSLGRREFSRARYISGVSLVSGWVLAVITVLSLVLFRSPLASMYNDDPAVLSIASTVLLFAGLFQPADFTQCIASYALRGYKVTKVPMFIHAAAFWGCGLLPGYLLAYRFDMGIYGFWTALIASLTIAAVALVWCLEKYSMELVKSHKAV

SEQ ID NO: 1483 - protein, 459 aa, Neisseria
MLLDLNRFSFPVFLKEVRLLTTLALPMLLAQVAQVGIGFVDTVMAGGAGKEDLAAVALGSSAFATVYITFMGIMAALNPMIAQLYGAGKTDEVGETGRQGIWFGLFLGVFGMVLMWAAITPFRNWLTLSDYVEGTMAQYMLFTSLAMPAAMVHRALHAYTSSLNRPRLIMLVSFAAFVLNVPLNYIFVYGKFGMPALGGAGCGLATMAVFWFSALALWIYIAKENFFRPFGLTAKFGKPDWAVFKQIWKIGAPIGLSYFLEASAFSFIVFLIAPFGEDYVAAQQVGISLSGILYMIPQSVGSAGTVRIGFSLGRREFSRARYISGVSLVLGWMLAVITVLSLVLFRSPLVSMYNNDPAVLSIAATVLLFAGLFQPADFTQCIASYALRGYKVTKVPMFIHAAAFWGCGLLPGYLLAYRFNMGIYGFWTALIASLTIAAIALVWCLELCSREMVRSHKAV

SEQ ID NO: 1484 - protein, 459 aa, Neisseria
MLLDLNRFSFSVFLKEVRLLTALALPMLLAQVAQVGIGFVDTVMAGGAGKEDLAAVALGSSAFATVYITFMGIMAALNPMIAQLYGAGKTDEVGETGRQGIWFGLFLGVFGMVLMWAAITPFRNWLTLSDYVEGTMAQYMLFTSLAMPAAMVHRALHAYASSLNRPRLIMLVSFAAFVLNVPLNYIFVYGKFGMPALGGAGCGLATMAVFWFSALALWIYIAKENFFRPFGLTAKFGKPDWAVFKQIWKIGAPIGLSYFLEASAFSFIVFLIAPFGEDYVAAQQVGISLSGILYMIPQSVGSAGTVRIGFSLGRREFSRARYISGVSLVSGWMLAVITVLSLVLFRSPLVSMYNNDPAVLSIAATVLLFAGLFQPADFTQCIASYALRGYKVTKVPMFIHAAAFWGCGLLPGYLLAYRFDMGIYGFWTALIASLTIAAIALVWCLELCSREMVRSHKAV

SEQ ID NO: 1485 - protein, 188 aa, Neisseria
MSALLPIINRLILQSPDSRSELTSFAGKTLTLNIAGLKLAGRITEDGLLSAGNGFADTEITFRNSAIRKILQGGEPGAGDIRLEGDLILGIAVLSLLGSLRSRASDELARIFGTQAGIGSRATDIGHGIKQIGRNIAEQIGGFSREPESANTGNEALADCLDEISRLRDGVERLNERLDRLERDIWID

SEQ ID NO: 1486 - protein, 188 aa, Neisseria
MSALLPIINRLILQSPDSRSELAAFAGKTLTLNIAGLKLAGRITEDGLLSAGNGFADTEITFRNSAVQKILQGGEPGAGDIGLEGDLILGIAVLSLLGSLRSRASDELARIFGTQADIGSRAADIGHGIKQIGRNIAEQIGGFSRESESANIGNEALADCLDEISRLRDGVERLNERLDRLERDIWID

SEQ ID NO: 1487 - protein, 188 aa, Neisseria
MSALLPIINRLILQSPDSRSELAAFAGKTLTLNIAGLKLAGRITEDGLLSAGNGFADTEITFRNSAVQKILQGGEPGAGDIGLEGDLILGIAVLSLLGSLRSRASDELARIFGTQADIGSRAADIGHGIKQIGRNIAEQIGRFSREPESANIGNEALADCLDEISRLRDGVERLNERLDRLERDIWID

SEQ ID NO: 1488 - protein, 131 aa, Neisseria
MVVDRLEILALDDETLDAFVGNQRSSDIAHHIFHEFRVFVGLFGNVFFIGAFEQAVELAARLRFHIIDNFLDTDFGIGSQADGNVRTLIMRAILGNFFGTRAKRGYGNHDLHTVAVCPVFHFTREADIIIQ

SEQ ID NO: 1489 - protein, 131 aa, Neisseria
MVVDRLEILALDDETLDAFVGNQRSSDIAHHIFHEFRVFVGFFGNVFFIGAFEQAVELAARLRLHIIDDFLDTDFGIGSQADGNVRTLVVRAVLGNFFGTRAKRGYGNHDLHTVAVCPVFDFARETDIIIQ

SEQ ID NO: 1490 - protein, 131 aa, Neisseria
MVVDRLEILALDDETLDAFVGNQRSSDIAHHIFHEFRVFVGFFGNVFFIGAFEQAVELAARLRLHIIDDFLDTDFGIGSQADGNVRTLVVRAILGNFFGTRAKRGYGNHDLHTVAVCTVFHFAREADIIIQ

SEQ ID NO: 1491 - protein, 338 aa, Neisseria
MIGGLMQFPYRNVPASRMRRMRRDDFSRRLMREHMLTADDLIYPVFVLEGAAREEDVPSMPGVKRQSLDRLLFTAEEAVKLGIPMLALFPVVTANKTGRAQEAYNPEGLVPSTVRALRERFPELGIMTDVALDPYTVHGQDGLTDENGYVMNDETVEVLVKQALCHAEAGTQVVAPSDMMDGRIGAIREALEDAGHIHTRIMAYSAKYASAFYGPFRDAVGSSGNLGKADKKTYQMDPANTDEALHEVALDIQEGADMVMVKPGLPYLDVVRRVKDEFGVPTYAYQVSGEYAMLQAAVANGWLDGGKVVLESLLAFKRAGADGILTYYAIEAAKMLKR

SEQ ID NO: 1492 - protein, 338 aa, Neisseria
MIGGLMQFPYRNVPASRMRRMRRDDFSRRLMREHTLTADDLIYPVFVLEGSAREEDVPSMPGVKRQSLDRLLFTAEEAVKLGIPMLALFPVVTANKTERAQEAYNPEGLVPSTVRALRERFPELGIMTDVALDPYTVHGQDGLTDENGYVMNDETVEVLVKQALCHAEAGAQVVAPSDMMDGRIGAIREALEDAGHIHTRIMAYSAKYASAFYGPFRDAVGSSGNLGKADKKTYQMDPANTDEALHEVALDIQEGADMVMVKPGLPYLDVVRRVKDEFGVPTYAYQVSGEYAMLQAAIANGWLDGGKVVLESLLAFKRAGADGILTYYAIEAAKMLKR

SEQ ID NO: 1493 - protein, 338 aa, Neisseria
MIGGLMQFPYRNVSASRMRRMRRDDFSRRLMREHTLTADDLIYPVFVLEGSAREEDVPSMPGVKRQSLDRLLFTAEEAVKLGIPMLALFPVVTANKTERAQEAYNPEGLVPSTVRALRERFPELGIMTDVALDPYTVHGQDGLTDENGYVMNDETVEVLVKQALCHAEAGAQVVAPSDMMDGRIGAIREALEDAGHIHTRIMAYSAKYASAFYGPFRDAVGSSGNLGKADKKTYQMDPANTDEALHEVALDIQEGADMVMVKPGLPYLDVVRRVKDEFGVPTYAYQVSGEYAMLQAAVANGWLDGGKVVLESLLAFKRAGADGILTYYAIEAAKMLKR

SEQ ID NO: 1494 - protein, 180 aa, Neisseria
MPSENGMGKRQLAGCRLFGKLSLVFRLLPGLCRGGVCRGRCFGFFPSRSVRRVIFRRVRILAQVVAVILGRAGLFARHNFQYLIAVYGFPFHQGFAHRFHLVAVFIEDFVGNLILLVQNPADFRVDVLLGFLGNVLRTGYAAPQEDFAFVFRINHHAHFVAHAVARYHFACHLGCAFKVV

SEQ ID NO: 1495 - protein, 180 aa, Neisseria
MPSENGMGKRQLAGCRLFGKLSLVFRLLLGLCRSGVCRGRCFGFFPSRSVRRVIFRRVRILAQVVAVIFGRAGLFARHDFQYLIAVDGFPFHQGFAHRFHLVAVFIEDFVGNLILLVQNPADFRVDVLLGFLGNVLRTGYAASQEDFAFVFRINHHAHFVAHAVARYHFARHLGCAFKVV

SEQ ID NO: 1496 - protein, 180 aa, Neisseria
MPSENRMGKRQLAGCRLFGKLSLVFRLLLGLCRSGVCRGRCFGFFPSRSVRRVIFRRVRILAQVVAVIFGRAGLFARHDFQYLIAVDGFPFHQGFAHRFHLVAVFIEDFVGNLILLVQNPADFRIDVLLGFLGNVLRTGYAASQEDFAFVFRINHHAHFVAHAVARYHFARHLGCAFKVV

SEQ ID NO: 1497 - protein, 124 aa, Neisseria
MGFGGNIAKKLAGVDEIAFDFDGIVFDFGRDDAVRHSGVINAAVAGLHIVGEVFADKAVEKCAENVLFKVPAIHRAAYFVGDFPNLAVQLGALLHFGHHRNPYIKLNKSKSPDIFRRFFYGHSN

SEQ ID NO: 1498 - protein, 124 aa, Neisseria
  VARIANT (1)...(124): Xaa = Any Amino Acid
MGFGGNIAKKLAGVDEIAFNFDGIVFDFGRDDAVRHSGVINTAVACLHIVGEVFADKAVEKCAENVLFKVPAIHRAAYFVGNFPNLAVQLGALLHFGHHRNPYXKLNKSKSPDIFRRFFYGHSN

SEQ ID NO: 1499 - protein, 124 aa, Neisseria
  VARIANT (1)...(124): Xaa = Any Amino Acid
MGFGGNIAKKLAGVDEIAFDFDGIVFDFGRDDAVRHSGVINTAVACLHIVGKVFADKAVEKCAENVLFEVPAIHRAAYFVGNFPNLAVQLGALLYFGHHRNPYXKLNKSKSPDIFRRFFXGHSN

SEQ ID NO: 1500 - protein, 204 aa, Neisseria
MSRSSLSRRSLRRSTPSRSLLISSRQSARASLPVFADSGSRENPPICSAMFLPICLMPCPMSVARLPMPACVPKIRANSSDARERRLPSRDSTAMPRMRSPSSLMSPAPGSPPWRIFRIALLRKVISVSAKPFPAESKPSSVMRPASFSPAMFRVSVLPAKEVSSERLSGLCRIRRLMMGRRADIFSDWGGECLLLLLPLILQA

SEQ ID NO: 1501 - protein, 204 aa, Neisseria
MSRSSRSRRSLRRSTPSRSLLISSRQSARASLPMFADSDSRENPPICSAMFLPICLMPCPMSAARLPMSACVPKIRANSSDARERRLPSRDSTAMPRMRSPSSPMSPAPGSPPWRIFCTALLRKVISVSAKPFPAESKPSSVMRPASFSPAMFRVSVLPAKAASSERLSGLCRIRRLMMGRRADIFSDRGGECLLLLLPLILQA

SEQ ID NO: 1502 - protein, 204 aa, Neisseria
MSRSSRSRRSLRRSTPSRSLLISSRQSARASLPMFADSGSRENLPICSAMFLPICLMPCPMSAARLPMSACVPKIRANSSDARERRLPSRDSTAMPRMRSPSSPMSPAPGSPPWRIFCTALLRKVISVSAKPFPAESKPSSVMRPASFNPAMFRVSVLPAKAASSERLSGLCRIRRLMMGRRADIFSDRGGECLLLLLTLILQA

SEQ ID NO: 1503 - protein, 391 aa, Neisseria
  VARIANT (1)...(391): Xaa = Any Amino Acid
MAAFNALDGKKEDNGQIEYSQFIRQVNNGEVSGVNIEGSVVSGYLIKGERTDKSTFFTNAPLDDNLIQTLLNKNVRVKVTPEEKPSALTALFYSLLPVLLLIGAWFYFMRMQAGGGGKGGAFSFGKSRARLLDKDANKVTFADVAGCDEAKEEVQEIVDYLKAPNRYQSLGGRVPRGILLAGSPGTGKTLLAKAIAGEAGVPFFSISGSDFVEMFVGVGASRVRDMFEQAKKNAPCIIFIDEIDAVGRQRGAGLGGGNDEREQTLNQLLVEMDGFESNQTVIVIAATNRPDVLDPALQRPGRFDRQVVVPLPDIRGREQXLNVHSKKVPLDESVDLLSLARGTPGFSGADLAKLVNEAPLFAGRRNKVKVDQSDLKTPKTKSIWVRNAAVW

SEQ ID NO: 1504 - protein, 391 aa, Neisseria
MAAFNALDGKKEDNGQIEYSQFIQQVNNGEVSGVNIEGSVVSGYLIKGERTDKSTFFTNAPLDDNLIKTLLDKNVRVKVTPEEKPSALAALFYSLLPVLLLIGAWFYFMRMQTGGGGKGGAFSFGKSRARLLDKDANKVTFADVAGCDEAKEEVQEIVDYLKAPNRYQSLGGRVPRGILLAGSPGTGKTLLAKAIAGEAGVPFFSISGSDFVEMFVGVGASRVRDMFEQAKKNAPCIIFIDEIDAVGRQRGAGLGGGNDEREQTLNQLLVEMDGFESNQTVIVIAATNRPDVLDPALQRPGRFDRQVVVPLPDIRGREQILNVHSKKVPLDESVDLLSLARGTPGFSGADLANLVNEAALFAGRRNKVKVDQSDLKTPKTKSIWVRNAAVW

SEQ ID NO: 1505 - protein, 391 aa, Neisseria
MAAFNALDGKKEDNGQIEYSQFIQQVNNGEVSGVNIEGSVVSGYLIKGERTDKSTFFTNAPLDDNLIKTLLDKNVRVKVTPEEKPSALAALFYSLLPVLLLIGAWFYFMRMQTGGGGKGGAFSFGKSRARLLDKDANKVTFADVAGCDEAKEEVQEIVDYLKAPNRYQSLGGRVPRGILLAGSPGTGKTLLAKAIAGEAGVPFFSISGSDFVEMFVGVGASRVRDMFEQAKKNAPCIIFIDEIDAVGRQRGAGLGGGNDEREQTLNQLLVEMDGFESNQTVIVIAATNRPDVLDPALQRPGRFDRQVVVPLPDIRGREQILNVHSKKVPLDKSVDLLSLARGTPGFSGADLANLVNEAALFAGRRNKVKVDQSDLKTPKTKSIWVRNAAVW

SEQ ID NO: 1506 - protein, 371 aa, Neisseria
MWKRRRRGVGSFEEQRIDAAGKPQCGKQAEAVARQLHAASSSSHVWQILDRRRNLPPRAASMSRHCATSSADGASSMLHSYSRKSRVSSMTGMDSVWISCLSSFMTVRIRKSGKCRLKGLQTALDYLLCRKRVASSHLPEMMSGTACRDLATASSICRRCFRARFVQDVADDEVAVAGVADAEAQAVIVCRAEFCLNVFQAVVSAVAAAEFEFDPSARDVEFVVDDEDFFGFDFVELCKRGNRLSGTVHERGRFEQPNIAVGQGGAGNFAEEFFFFFKRSLPFPRQFVEEPKARIVAGLFVFFARVAQADNHFDCVRHDIFRVSVECGLKASDGMVILLDFERVCGALLWGRSTAGGTLRCGRRRAAACRL

SEQ ID NO: 1507 - protein, 371 aa, Neisseria
  VARIANT (1)...(371): Xaa = Any Amino Acid
MRKRRWRGFGSFEKQXVNAACKPQCREQDKAVAWQIHACSSSSHVWHSLDRRRNFPPRAASISRQTAISSAEGASSMLHSXSRKSRVSSMTGMDSVWISCLSSVMTVRIWKSGTCRLKGLQTASGHLLCRKRVASSHLPARMSGMACRDLATASSICRRCXRTGFVQDIADDEVAVARVADAEAQAVIVCRAEFCLNVFQAVVSAVAAAEFEFDPSAGNVEFVVDDEDFFGFDFVELCKRGNCLSGTVHERGRFEQPNVAVGQGGTGDFAEEFFFFFKXSLPFPRQFVEEPKTRIVACLFVFFARVAQADNHFDCVXHDIFRVSVECCLKASDGMVILLDFERVCGALLWGRSTAGGTLRCGRRRAAACRL

SEQ ID NO: 1508 - protein, 369 aa, Neisseria
  VARIANT (1)...(369): Xaa = Any Amino Acid
MRKRRRRGVGSFEEQRIDAAGKPQCGKQAEAVARQLHAASSSSHVWQILDRRRNLPPRAASMSRHCATSSADGASSMLHSYSRKSRVSSMTGMDSVWISCLSSVMTVRIWKSGTCRLKGLQTASGHLLCRKRVASSHLPARMSGMACRDLATASSICRRXFRTGFVQDIADDEVAVARVADAEAQAVIVCRAEFCLNVFQAVVSTVAAAEFEFDPSAGNVEFVVDDEDFFGFDFIKLRKGGNCLSGTVHERGRLEQPDIAVGQGSTGDFAEEFFFFFKSLPFPRQFVEEPKTRIVACLFVFFARVAQADNHFDCVHDIFRVSAECRLKASDGMVILLDFERVCGALLWGRSTAGGTLRCGRRRAAACRL

SEQ ID NO: 1509 - protein, 401 aa, Neisseria
MSNTIKMVVGLGNPGKEYEQTRHNAGFWFLDELAWKWKASFKEEKKFFGEVARAALPDGDVWLLKPATFMNRSGQAVAALAQFYKIKPEEILVVHDELDIPCGRIKFKLGGGNGGHNGLKDIQAKLGTADYYRLRLGIGHPGDRNLVVGYVLNKPSAEAPPANRRCRRQIPAGRTRHHFRQMGRGNALPAQQIIQCRLKPFQTAFSRFPYPNSHERTQAAYPNGIHPRHRRNPRFPAVRMQHRRSTVRRRSGTMARHTCRTRRQIPAPVQNLPNVAGRGGGMKLPRNRFSLLSALWFAGGIYSLLFKAADTAPPPFPHFDKAAHLALFFAQILFLAKAFKTGKLPIPYRSLIAFAFCFAVGSECAQAWFTATRTGSLGDVLADLTGAALALFAARSACRPD

SEQ ID NO: 1510 - protein, 401 aa, Neisseria
  VARIANT (1)...(401): Xaa = Any Amino Acid
MSNTIKMVVGLGNPGKEYEQTRHNAGFWFLDELAWKWKASFKEEKKFFGEVARAALPDGDVWLLKPATFMNRSGQAVAALAQFYKIKPEEILVVHDELDIPCGRIKFKLGGGNGGHNGLKDIQAKLGTADYYRLRLGIGHPGDRNLVVGYVLNKPSTEXPPTDXRCRRQIPASHTRHPCRQMGRSNPLPAQQMTRCRLKPFQTACSRFPYPNSHDRTQAAYPNRIHPRHRRNPRFPALRMQHRRCPLRRRNCRLARYAGRTRRKIPAPIQTMPDMAXRGTSMNLPRNRFILLSALWFAGSIYSLLFKAAETAPPPFPHFDKVAHLALFFAQIWLLTKAFRTDNRPIPYRSLMVFALCFALFSECAQAWFTATRTGSLGDVLADLTGAALALFTARAACRPD

SEQ ID NO: 1511 - protein, 398 aa, Neisseria
  VARIANT (1)...(398): Xaa = Any Amino Acid
MSNTIKMVVGLGNPGKEYEQTRHNAGFWFLDELAWKWKASFKEEKKFFGEVARATLPDGDVWLLKPTTFMNRSGQAVAALAQFYKIKPEEILVVHDELDIPCGRIKFKLGGGNGGHNGLKDIQAKLGTADYYRLRLGIGHPGDRNLVVGYVLNKPSTEXPPTDRCRRQIPASHTRHPCRQMRGNPLPAQQMTRCRLKPFQTACSRFPYPNSHDRTQAAYPNRIHPRHRRNPRFPAVRMQHRRRTIRRRSGTMARHTCRTRRQIPAPVQNLPNVAGRGGGMKLPRNRFSLLSALWFAGGIYSLLFKAADTAPPPFPHFDKAAHLALFFAQIWLLTKAFKTGKLPIPYRSLMVFALCFALFSECAQAFTATRTGSLGDVLADMAGTVLALFAARAADRPD

SEQ ID NO: 1512 - protein, 324 aa, Neisseria
MPSEKNIGFMAGSSRPLRVAFALLLVSCILFMTLNVKGDWDFVLHLRLTKLAALLMVAYAVGVSTQLFQTLTNNPILTPSILGFDSLYVFLQTLLVFTFGGVGYTSLPLTGKFGFELVVMMGGSLLLFYTLIRQGGRDLPHMILIGVIFGILFRSLSSLLSRMIDPEEFTAAQANMFAGFNTVRSELLGIGALVLLVSAAVVWHERYRSDVHLLGRDQAVNLGISYTRNTLWILLWIAALVATATAVVGPVSFFGLLAASLANHFSPSVRHSVRLPMTVCVGGILLVGGQTVFEHFLGMKAVLSVVVEFAGGLVFLYLVLKHKK

SEQ ID NO: 1513 - protein, 324 aa, Neisseria
MPSEKNIGFMAGSSRPLWVAFALLLVSCVLFMTLNVKGDWDFVLQLRLTKLAALLMVAYAVGVSTQLFQTLTNNPILTPSILGFDSLYVFLQTLLVFTFGGVGYASLPLTGKFGFELVVMMGGSLLLFYTLIKQGGRDLSRMILIGVIFGILFRSLSSLLSRMIDPEEFTAAQANMFAGFNTVHSELLGIGALILLVSAAVVWRERYRLDVYLLGRDQAVNLGISYTRNTLWILLWIAALVATATAVVGPVSFFGLLAASLANHFSPSVKHSVRLPMTVCIGGILLVGGQTVFEHLLGMQAVLSVVVEFAGGLVFLYLVLKHKK

SEQ ID NO: 1514 - protein, 324 aa, Neisseria
MPSEKNIGFMAGSSRPLWVAFALLLVSCILFMTLNVKGDWDFVLHLRLTKLAALLMVAYAVGVSTQLFQTLTNNPILTPSILGFDSLYVFLQTLLVFTFGGVGYASLPLTGKFGFELVVMMGGSLLLFYTLIKQGGRDLPRMILIGVIFGILFRSLSSLLSRMIDPEEFTAAQANMFAGFNTVHSELLGIGALILLVSAAVVWRERYRLDVHLLGRDQAINLGISYTRNTLWILLWIAALVATATAVVGPVSFFGLLAASLANHFSPSVKHSVRLPMTVCVGGILLVGGQTVFEHFLGMKAVLSVVVEFAGGLVFLYLVLRHKK

SEQ ID NO: 1515 - protein, 164 aa, Neisseria
MKKTLLAIVAVFALSACRQAEEAPPPLPRQISDRSVGHYCSMNLTEHNGPKAQIFLNGKPDQPVWFSTVKQMFGYTKLPEEPKGIRVIYVTDMGNVTDWTNPNADTEWIDAKKAFYVIDSGFIGGMGAEDALPFGNKEQAEKFAKDKGGKVVGFDDMPDAYIFK

SEQ ID NO: 1516 - protein, 164 aa, Neisseria
MKKTLLAIVAVSALSACRQAEEGPPPLPRQISDRSVGHYCSMNLTEHNGPKAQIFLNGKPDQPVWFSTIKQMFGYTKLPEEPKGIRVIYVTDMGNVTDWTNPNADTEWMDAKKAFYVIDSGFIGGMGAEDALPFGNKEQAEKFAKDKGGKVVGFDDMPDTYIFK

SEQ ID NO: 1517 - protein, 164 aa, Neisseria; identical to SEQ ID NO: 1516

SEQ ID NO: 1518 - protein, 415 aa, Neisseria
MQLTAVGLNHQTAPLSIREKLAFAAAALPEAVRNLARSNAATEAVILSTCNRTELYCVGDSEEIIRWLADYHSLPIEEIRPYLYTLDMQETVRHAFRVACGLDSMVLGEPQILGQIKDAVRAAQEQESMGAKLNALFQKTFSVAKEVRTDTAVGENSVSMASASVKLAEQIFPDIGDLNVLFIGAGEMIELVATYFAAKNPRLMTVANRTLARAQELCDKLGVNAEPCLLSDLPAILHDYDVVVSSTASQLPIVGKGMVERALKQRQSMPLFMLDLAVPRDIEAEVGDLNDAYLYTVDDMVNIVQSGKEARQKAAAAAETLVSEKVAEFVRQQQGRQSVPLIKALRDEGEKARKQVLENAMKQLAKGATAEEVLERLSVQLTNKLLHSPTQTLNKAGEEDKDLVHAVAQIYHLDK

SEQ ID NO: 1519 - protein, 415 aa, Neisseria
MQLTAVGLNHQTAPLSIREKLAFAAAALPKAVRNLARSNAATEAVILSTCNRTELYCVGDSEEIIRWLADYHSLPIEEIRPYLYALDMQETVRHAFRVACGLDSMVLGEPQILGQIKDAVRVAQEQESMGKKLNALFQKTFSVAKEVRTDTAVGENSVSMASASVKLAEQIFPDIGDLNVLFIGAGEMIELVATYFAAKSPRLMTVANRTLARAQELCDKLGVNAEPCLLSDLPAILHDYDVVVSSTASQLPIVGKGMVERALKQRQSMPLFMLDLAVPRDIEAEVGDLNDAYLYTVDDMVNIVQSGKEARQKAAAAAETLVSEKVAEFVRQQQGRQSVPLIKALRDEGEKARKQVLENAMKQLAKGATAEEVLERLSVQLTNKLLHSPTQTLNKAGEEDKDLVHAVAQIYHLDK

SEQ ID NO: 1520 - protein, 415 aa, Neisseria
MQLTAVGLNHQTAPLSIREKLAFAAACLPEAVRNLARSNAATEAVILSTCNRTELYCVGDSEEIIRWLADYHSLPIEEISPYLYTLGMQETVRHAFRVACGLDSMVLGEPQILGQIKDAVRVAQEQESMGKKLNALFQKTFSVAKEVRTDTAVGENSVSMASASVKLAEQIFPDIGDLNVLFIGAGEMIELVATYFAAKSPRLMTVANRTLARAQELCDKLGVNAEPCLLSDLPAILHEYDVVVSSTASQLPIVGKGMVERALKQRQSMPLFMLDLAVPRDIEAEVGDLNDAYLYTVDDMVNIVQSGKEARQKAAAAAETLVSEKVAEFVRQQQGRQSVPLIRALRDEGEKARKQVLENAMKQLAKGATAEEVLERLSIQLTNKLLHSPTQTLNKAGEEDKDLVHAVAQIYHLDK

SEQ ID NO: 1521 - protein, 119 aa, Neisseria
  VARIANT (1)...(119): Xaa = Any Amino Acid
MIRYLLIACGGISLLLGIIGIFLPLLPTTPFVLLSAACWAKASPRFHRWLHRHRYFGPMVHNWEQNGAVPRKAKIFAISMITASCLMIFWHFPQXWWVGAVSSVFCSLVTIRMWHRPES

SEQ ID NO: 1522 - protein, 119 aa, Neisseria
MIRYLLIACGCISLLLGIIGIFLPLLPTTPFVLLSAACWAKASPRFYRWLHRHRYFGPMVHNWEQNGAVPRKAKIFAISMMTASCLIMFWQFPQRWWVGAVSSVFCSLVAIWMWRRPES

SEQ ID NO: 1523 - protein, 119 aa, Neisseria
MIRYLLIACGCISLLLGIIGIFLPLLPTTPFVLLSAACWAKASPRFHRWLHRHRYFGPMVHNWEQNGAVPRKAKIFAISMMTASCLIMFWQFPQRWWVGAVSSVFCSLVAIWMWRRPES

SEQ ID NO: 1524 - protein, 117 aa, Neisseria
MFATRKMKKMTMCTRRVRSWLAFSSGRIISIAAPVVPMIEASAVPTASRAVLSLGVPFKSPQTKMPPEMVYRASSSRMKGIYSSTSACATVWIPADAPKTKLNGMRKSNVQKAVILP

SEQ ID NO: 1525 - protein, 117 aa, Neisseria
MFATRKMKKMTMCTRRVRFWLAFSSGRIISIAAPVVPMIEASAVPTASRAVLSLGVPFKSPQTKMPPEMVYRASSSRMKGMYSSTSACATVWIPADAPKTKLNGMRKSNVQKAVILP

SEQ ID NO: 1526 - protein, 117 aa, Neisseria; identical to SEQ ID NO: 1525

SEQ ID NO: 1527 - protein, 210 aa, Neisseria
MSGLWKPEHPGFEILGSRYALQNLVRDVILITLTAVSMAITPKQVRAGNEFNFEPIAEVGKLFLGIFITIFPVLSILKAGEAGALGGVVSLVHDTAGHPINTMYFWMSGILSAFLDNAPTYLVFFNMAGGDAQALMTGPLFHSLLAVSMGSVFMGALTYIGNAPNFMVKAIAEQRGVPMPTFFRYMMWSVAFLTPVFIVHTLVFFVFKLL

SEQ ID NO: 1528 - protein, 210 aa, Neisseria
MSGLWKPEHPGFEILGSRYALQNLVRDVILIALTAVSMAITPKQVRAGNEFNFEPIAEVGKLFLGIFITIFPVLSILKAGEAGALGGVVSLVHDTAGHPINVMYFWMSGILSAFLDNAPTYLVFFNMAGGDAQALMTGTLFHSLLAVSMGSVFMGALTYIGNAPNFMVKAIAEQRGVPMPTFFGYMMWSVAFLTPVFIVHTLIFFVFKLL

SEQ ID NO: 1529 - protein, 210 aa, Neisseria
MSGLWKPEHPGFEILGSRYALQNLVRDVILIALTAVSMAITPKQVRAGNEFNFEPIAEVGKLFLGIFITIFPVLSILKAGEAGALGGVVSLVHDTAGHPINVMYFWMSGILSAFLDNAPTYLVFFNMAGGDAQALMTGSLFHSLLAVSMGSVFMGALTYIGNAPNFMVKAIAEQRGVPMPTFFGYMMWSVAFLTPVFIVHTLIFFVFKLL

SEQ ID NO: 1530 - protein, 119 aa, Neisseria
MCVPLKPAGCGPPNSCVSILAAFSDGTSAPAALHTWILRSVRRLNTNRPRLKSSAASLMMTVGSAASGLVSIALTKMANGSASTAGILLNGRVRSAVHKPDIRLRRTFSLLNFASASGT

SEQ ID NO: 1531 - protein, 120 aa, Neisseria
MCVPLKPAGCGPPNSCVSMLAAFSDGTSAPAALQTWILRSVKRLNTNRPRLKSSAASLIMTVGSAASGLVSIALTKMANGSASTAGILLNGRVRSAVHKPDWIRLRRTSSPLKFASASGA

SEQ ID NO: 1532 - protein, 120 aa, Neisseria
MCVPLKPAGCGPPNSCVSMLAAFSDGTSAPAALHTWILRSVKRLNTSKPRLKSSAASLITTTGSAASGLVSIALTKMANGSASTAGILLNGRVRSAVHKPDWIRLRRTSSPLKFANASGA

SEQ ID NO: 1533 - protein, 322 aa, Neisseria
  VARIANT (1)...(322): Xaa = Any Amino Acid
MTAKPFSLNLANLLLPAVLFAVSLSVGIADFRWSDVFSLSDSQQVMFISRLPRTFAIVLTGASIAVAGMIMQILMRNRFVEPSMAGAGQSAALGLLLMSLLLPAAPLPVKMSVAAVAALIGMLVFMLLIRRLPPTAQLMVPLVGXIFGGVVEAVATFVAYEFEMLQMLGVWQQGDFSSVLLGRYELLWITGGLAVFAYLIADRLTILGLGETVSVNLGLNRTAVLWSGLIIVALITSLVIVTVGNIPFIGLVVPNIVSRLMGDRLRQSLPAVALLGASLVLLCDIIGRMIVFPFEIPVSTVFGVLGTALFLWLLLRKPAYAV

SEQ ID NO: 1534 - protein, 322 aa, Neisseria
MTAKPFSLNLTNLLLLAVLFAVSLSVGVADFRWSDVFSLSDSQQVMFISRLPRTFAIVLTGASMAVAGMIMQILMRNRFVEPSMVGASQSAALGLLLMTLLLPAAPLPAKMSVAAVAALIGMLVFMLLIRRLPPTAQLMVPLVGIIFGGVIEAVATFIAYENEMLQMLGVWQQGDFSSVLLGRYELLWITGGLAVFAYLIADRLTILGLGETVSVNLGLNRTAVLWSGLIIVALITSLVIVTVGNIPFIGLVVPNIISRLMGDRLRQSLPAVALLGASLVLLCDIIGRVIVFPFEIPVSTVFGVLGTALFLWLLLRKPAYAV

SEQ ID NO: 1535 - protein, 322 aa, Neisseria
MTAKPFSLNLTNLLLLAVLFAVSLSVGVADFRWSDVFSLSDSQQVMFISRLPRTFAIVLTGASMAVAGMIMQILMRNRFVEPSMAGAGQSAALGLLLMSLLLPAAPLPVKMSVAAVAALIGMLVFMMLIRRLPPTAQLMVPLVGIIFGGVVEAVATFIAYENEMLQMLGVWQQGDFSGVLLGRYELLWATGILALFAYLIADQLTILGLGETVSVNLGLNRTAILWSGLIIVALITSLVIVTVGNIPFIGLVVPNIISRLIGDRLRQSLPAVALLGASLVLLCDIIGRVIVFPFEIPVSTVFGVLGTALFLWLLLRKPAHAV

SEQ ID NO: 1536 - protein, 284 aa, Neisseria
MMILVWLALFPPMFYGMYNVGAQAFGALTPDLLQQSIAHDGNYALANALGINMSPEAGVLGKMLFGAIYFLPIYATVFIVGGFWEVLFASVRKHEINEGFFVTSILFALIVPPTLPLWQAALGISFGVVVAKEVFGGTGKNFMNPALAGRAFLFFAYPANLSGDAVWTAVDGYSGATALAQWAAHGADGLKNAVTGQTITWMDAFIGKLPGSIGEVSTLALLIGGAFIVFARIASWRIIAGVMIGMIAMSSLINFIGSDTKAMFAMHLVHGTWWKDDYHSLYIK

SEQ ID NO: 1537 - protein, 355 aa, Neisseria
MMILVWLALFPAMFYGMYNVGAQAFGALTPDLLQQNIANDWHYAFANALGINMSSEAGVSDKMLFGAIYFLPIYATVFVVGGFWEVLFATVRKHEINEGFFVTSILFALIVPPTLPLWQAALGISFGVVVAKEVFGGTGKNFMNPALAGRAFLFFAYPANLSGDAVWTAVDGYSGATALAQWAAHGADGLKNAVTGQTITWMDAFIGKLPGSIGEVSTLALLIGGAFIVFARIASWRIIAGVMIGMIAMSSLFNFIGSDTNAMFAMPWYWHLVVGGFAIGMLFMATDPVSASFTNVGKWWYGALIGVMCVLIRVVNPAYPEGMMLAILFANLFAPIFDYFVAQANIKRRKARSNG

SEQ ID NO: 1538 - protein, 355 aa, Neisseria
MMILVWLALFPAMFYGMYNVGAQAFGALTPDLLQQSIANDWHYALANALGINMSSEAGVLGKMLFGAIYFLPIYATVFIVGGFWEVLFATVRKHEINEGFFVTSILFALIVPPTLPLWQAALGISFGVVVAKEVFGGTGKNFMNPALAGRAFLFFAYPANLSGDAVWTAVDGYSGATALAQWAAHGADGLKNAITGQTITWMDAFIGKLPGSIGEVSTLALLIGGAFIVFARIASWRIIAGVMIGMIAMSSLFNFIGSDTNAMFAMPWYWHLVVGGFAIGMLFMATDPVSASFTNVGKWWYGALIGVMCVLIRVVNPAYPEGMMLAILFANLFAPIFDYFVAQANIKRRKARSNG

SEQ ID NO: 1539 - protein, 146 aa, Neisseria
MTRRRVGKQNRIAIHSAQYRKMVVFAVFQIHDDGDFQLRELFERQGIAFRLKTQIGHNAPHILKRRAHLFLTQFFQHFFFRQLLPVKIVQKRRHRSRPAGKIQILLYNIEIPPRFPTLQFDFSVNNRIIVKHRCSIQTIRQGSVPD

SEQ ID NO: 1540 - protein, 130 aa, Neisseria
MTQRRVGKQNRIAVYTAQYREMIILAVFQIHDDGDLQLCKLLERQGIAFRFKTQIRHNAPHILKRRGHLLLIQFFHVLFRQLLPVKIVQKRHHRSRPAGKIQILLYNIEIAPFFPTLHFDFSISNRIIVD

SEQ ID NO: 1541 - protein, 131 aa, Neisseria
MTQRRVGKQNRIAVYTAQYREMIILAVFQIHDDGDLQLCKLLERQGIAFRLKTQIRHDAPHILKRRAHLLLIQLFQHVLFRQLLPVKIVQKRRHRSRPAGKIQILLYNIEIAPFFPTLHFDFSISNRIIVD

SEQ ID NO: 1542 - protein, 331 aa, Neisseria
MIGGQFIVVGIVGKNALARFVDNIVVNIGIVDIVEHDALIAAADGDIVEHFEPFGKHQHIAHIVAHGNIAADFAVVGVHIVDGETQVAEAVVFIGVVRAGIGKNAVPPFGNVVADDLRAGRVPNGNAIAALIHAQGRIADDFILAHHRIGRTMKVYAERIIKNIVVFNQGARGGFFEINTGIHCWQAHTGTGNGQVAERYVRRVYGYGTPALVPFDGCGTVGRPFNRNRFVDIKFGLIYAGSQFDRIARPGAGKNFGKVVLRGNVDDGCRCRLKNAAGGKYQHGLQPYTERGCVHSVPLFRSVWPNKIKHHSNVPVFIAKPPETVRQAVWL

SEQ ID NO: 1543 - protein, 264 aa, Neisseria
MIGEKFIVVGIIGKYALACLVDNVVVNIGIVDIVEHNALIAAADGDIVEYFEPLGKHQHIAHIVAHGNIAADFAVVGVHIVDGETQIAEAVVFVGVVRAGIGKNAVPPFGNVVADDLRTGCVPNGNAVAALVHAQSRVADDFILAHHRIGRTMQIYADRIIQNIVVFNQGARGSFFEINTGIHCGQAHTGTGNGQVAERYVRRVYGYGTPAPVAFDGCGTVGRPFNRNRFVNVKFGFIYAGSQFERIARPGAGKCGIPISIIGS

SEQ ID NO: 1544 - protein, 265 aa, Neisseria
MIGGQFIVVGIVGKNALARFVDNVVVNIGIVDIVEHDALVAAADGDIVKHFEPLGKHQHIAHIVAHGNIAADFAVVGVHIVDGETQIAEAVVFIGVVRAGIGKNAVPPFGNIVADDLRAGRVPNGNAIAALVHAQSRVADDFILPHHRIGRTMQIDADRIIQNIIVFNQGARGSFFEINTGIHCGQAHTGTGNGQVAERYVRRVYGYGTPAPVSFDGCRTVGRPFNRNRFVDVKFGLIYAGSQFERIARPGAGKCGIPISIIDSW

SEQ ID NO: 1545 - protein, 343 aa, Neisseria
MSLPAMDAGIYLEKAAPRALVEHNNIFDNSFGVYLHGSADAMVRENKIVGDATLRVNERGNGVTVWNAPGAQVVGNDISKGRDGIFSNTSTHNTYKNNRFSDLRFAVHYMYTNDSEVSGNISVGNNMGYVLMFSERLKVFDNIAVGSRDGIMLNYVNYSDIHDNIINKAGKCVFAYNANYDKLSANHFENCQIGMHFTAAIEGTSLHDNSFINNGSQVKYVSTRFLDWSEGGHGNYWSDNSPFDLNGDGFGDSAYRPDGIIDQIIWRAPVSRLLMNSPAISIVKWAQAQFPAVLPGGVVDSKPLMKPYAPKIQTRYQAMKDELLKEAETRQSERGRAENGSLN

SEQ ID NO: 1546 - protein, 344 aa, Neisseria
MSLPAMDAGIYLEETAPRALIEHNNILDNSVGVYLHGSADAMVRENKIVGDATLRVNERGNGVTVWNAPGAQVVGNDISKGRDGIFSNTSTHNTYKNNRFSDLRFAVHYMYTNDSEISGNISVGNNMGYVLMFSERLKVFDNIAVGSRDQGIMLNYVNYSDIHDNIINKAGKCVFAYNANYDKLFANHFENCQIGIHFTAAIEGTSLHDNSFINNESQVKYVSTRFLDWSEGGHGNYWSDNSAFDLNGDGFGDSAYRPNGIIDQIIWRAPVSRLLMNSPAISIVKWAQAQFPAVLPGGVVDSKPLMKPYAPKIQTRYQAMKDELLKEVETRQSEWGRAENGSLN

SEQ ID NO: 1547 - protein, 344 aa, Neisseria
MSLPAMDAGIYLEETAPRALIEHNNILDNSVGVYLHGSADAMVRENKIVGDATLRVNERGNGVTVWNAPGAQVVGNDISKGRDGIFSNTSTHNTYKNNRFSDLRFAVHYMYTNDSEISGNISVGNNMGYVLMFSERLKVFDNIAVGSRDQGIMLNYVNYSDIHDNIINKAGKCVFAYNANYDKLSANHFENCQIGIHFTAAIEGTSLHDNSFINNESQVKYVSTRFLDWSEGGHGNYWSDNSAFDLNGDGFGDSAYRPNGIIDQIIWRAPVSRLLMNSPAISIVKWAQAQFPAVLPGGVVDSKPLMKPYAPKIQTRYQAMKDGLLKKVETRQLEWGRAENGSLN

SEQ ID NO: 1548 - protein, 396 aa, Neisseria
MIHIISILKSIGISGIAMSCFSIRRMSAFRARITAFFTAFVFLTAALPAYAERLPDFLAKIQPSEIFPGADRYGKPEGKPMVARVYKGDEQLGLVYITTDAVNTRGYSSKPIDTLMALANDGTIAGAKLVDHHEPIMLIGIPQSRVDKFIDKYIGLNFIKNPPTPSVAPGDIISGATVTLMVVNDSIQRSYKVIANQYRLGSDKALQTASASDVREAAPASETRPRRMANPDKQDILSWDELLKQKAVGHLHITLDQINKLFEKGGKAGVADHAEQGDPDDTFIDLYVALVSQPSIGKSLLGEDGWAHLQKRLKPGQQAVLVAGEGRYSWKGSGYVRGGIFDRIEMIQGENSFRFTDAQHERVVELSAADAPRFKEVSWFTIPEGVAFDGAEPWRL

SEQ ID NO: 1549 - protein, 143 aa, Neisseria
MIHIISILKSIGISGIVMSCFSIKRMSAFRARITAFFAAFVFLTAALPAYAERLPDFLAKIQPSEIFPGADRYGKPEGKPMVARVYKGDEQLGLVYITTDAVNTRGYSSKPIDTLMVLANDGTIAGAKLVDHHEPIMLIGIPH

SEQ ID NO: 1550 - protein, 143 aa, Neisseria
MIHIISILKSIGISGIVMSCFSIKRMSAFRARITAFFAAFVFLTAALPAYAERLPDFLAKIQPSEIVPGADRYSKPEGKPMVARVYKGDEQLGLVYITTDAVNTRGYSSKPIDTLMALAKDGTIAGAKLVDHHESIMLIGIPH

SEQ ID NO: 1551 - protein, 430 aa, Neisseria
MRYPPQSAVLQNAARCLLRRPKSACRRICPLSAISAVQYIFADVVQQEGCGVFVFLLYEDKKSGDDFADEDFLQGAGVGQGVFLQEAADVFGQSVVAGNGGKADIGLHGVEQGLVFVQLNACFFFFGGGADELVVNFGIKHIVRAFKNREGADIDGDIAGWVSAFKTLRAQEFLQHLRGGVSVFRGEGFDDVRLHQLMGDGRDGRNGMADVAVKDFGNLMAALDFAAFVIDESDIVADISVQVVKDVFHNAVRHADQLQAAADKDVLERAQTGSVAPGEFHHGGCRHFGIDAVDGVTDGAQAFGCEGFAADVCFGDEQQVDDFGEFAVFALFGGNEEEVALRIALPVFRGVDVNGLFVGIFVAGLHFACNRRAGGFGFGNAQTAAFAFENHVQTLCDLRFAAELLQRLQHQRAFDAGTQRNGHAVMPRNP

SEQ ID NO: 1552 - protein, 407 aa, Neisseria
ACRRICPLPAISAVQYIFADVVQQEGCGVFVFRLYEDKESGDDFADKDFLQGAGIGQGVFLQEAADVFRQSVVAGDGGKAGIGLQAVEQGLVFVQLHACFFFFGGGADKLVVNFGIKHIVRAFKNREGADVDSDIAGGVSAFKTLRTQEFLQHLRGGVSVFRGEGFDDVRLHQLMGDGGNRRNGMADVAVKNLGNLMAAPDFAAFVIDEFDVVADVSFQIFKDVFHNAVRHADQLQAAADKDVLERAQTGSVALGEFHHGGCRHFGIDAVDGVTDGAQAFGCEGFAADVCFGDEQQVDDFGEFAVFALFGGNEEEVALRVALPVFRGVDVNGLSVDIFVVGLHFACNRRAGGFGFGNTQTAALAFENHLQTLRDLRFIAELLQWLQHQRAFDAGTQRNGHAVMPRNP

SEQ ID NO: 1553 - protein, 406 aa, Neisseria
ACRRICPLSAISAVQYVFADVVQQEGCGVFVFRLYEDKESGDDFADKDFLQGAGIGQGVFLQEAADVFGQSVVAGDGGKAGIGLQAVEQGLVFVQLHACFFFFGGGADKLVVNFGIKHIVRAFKNREGADVDSDIAGGVSAFKTLRAQEFLQHLRGGVSVFRGEGFDDVRLHQLMGDGCNGRNGMADVAVKNLGNLMAAPDFAAFVIDESDVVADVSFQVFKGVFHNAVRHADQLQAAADKDVLERAQTGSVALGEFHHGGCRHFGIDAVDGVTDGAQAFGCEGFAADVCFGDEQQVDDFGEFAVFALFGGNEEEVALRVALPVFRGVDVNGLSVGIFVVRLHFSGNRRAGGFGFGNATAALAFENHVQTLCDLRFIAELLQWLQHQRAFDAGTQRNGHAVMPRNP

SEQ ID NO: 1554 - protein, 136 aa, Neisseria
  VARIANT (1)...(136): Xaa = Any Amino Acid
MVLPLMLLATIRSATLTLXRLAMLNRVSPSTTRWMLAWSGEVSASPSAALATRVSKRARRLPSAATVCCGDEEMLCSATVSGVPMTAEMVSSACRRRLFRATSCMSSSAACMSFGGMTCASVAVWVSDGMAVCFSV

SEQ ID NO: 1555 - protein, 135 aa, Neisseria
MVLPLMLLATIRSATLTLRLAMLNRVSPSTTRWMLAWSGEISASPSAALATRVSKRTRRLPSAAAVCCGDAEILCSATVSGVPMTAEMVSSACRRRLFRATSCMSSSAACMSFWGMICASVAVWVSDGMAVCFSV

SEQ ID NO: 1556 - protein, 135 aa, Neisseria
MVLPLMLLATIRSATLTLRLAMLNRVSPSTTRWMLAWSGEISASPSAALATRVSKRTRRLPSAATVCCGDEEMLCSATVSGVPMTAEMVSSACRRRLFRATSCMSSSAACMSFWGTICASVAVWVSDGMAVCFSV

SEQ ID NO: 1557 - protein, 517 aa, Neisseria
MPSERPADCCPVHFVVKFRKLTLNCGRRFDRPPINGNRQRKPMIHTEPSAQPSTMDTAAFLKHIESAFPRIFSDGIDLMRYLPEDKWLALKQAGLLLPFLDKKHGGRKGSQFEIQEVLRIAGHYGVPVTLRTGIEGALVLQPLQEFGGEAQVAQGLDMIFKGESRRLGVTEPETSGAAIAREMQSCYEYTDEQTIYVNAAKYWQGNSQSDFLLVAAKERKNGKLAKVIDLLLVPKTYIRCETLASEGLRAVRYAVNRIDAEMPATAVMKLSRGDAAGLRAFQNIFIRSRLQLIGMTHGIMEYILDNLNRYVRNDIRFVDYERREIQRRHQVSEILYRYVCHSVSPVAPVAHQLMEANIVKTLATEYTYAAAQMLQKLLGAKGFERGHPAGNIAIDIRPFTIFEGPNDMLYAEIYDQFVRATAEEKEAGIKLDKNQTLLDAVQTDVRFAAVARDYALPEDIRSFLQEHTLTDACALQKVFIGKIIARLFVFVQEEHEDTTAFLLNDIRKDILDCRYCG

SEQ ID NO: 1558 - protein, 517 aa, Neisseria
MPSERSADCCPAHFVVKFRKSTLNCGRRFDRPPINGNRQRKPMIHTEPSAQPSTMDTAAFLKHIESAFRRIFSDGIDLMRYLPEDKWLALKQAGLLLPFLDKKYGGRKGSQFEIQEVLRIAGHYGVPVTLRTGIEGALVLQPLQEFGDEAQVAQGLEMIFKGEGGGLGVTEPETSGAAIAREMQSYYEYIDGQTIYVNAAKYWQGNSQSDFLLVAAKERKNGKLAKVIDLLLVPKTYIRCETLASEGLRAVRYAVNRIDAEMPATAVMKLSQSDAAGLRAFQNIFIRSRLQLIGMTHGIMEYILENLERYVRNDIKFVDYERREIRRRHQVSEILYRYVCHSVSPVAPVAHQLMEANIVKTLATEYTYAAAQMLQKLLGAKGFERGHTAGNIAIDIRPFTIFEGPNDMLYAEIYDQFVRATAEEKEAGMKLDKNQTLLDRLQTDARFAAVARDYTLPEDIRSFLQEHTLTDACALQKVFIGKIIARLFVFVQAKHEDTAAFLLNDIRKDILDCRYCG

SEQ ID NO: 1559 - protein, 517 aa, Neisseria
  VARIANT (1)...(517): Xaa = Any Amino Acid
MPSERSADCCPAHFVVKFRKSTLNCGRRFDRPPINGNRQRKPMIHTEPSAQPSTMDTAAFLKHIESAFRRIFADGIDLMRYLPEDKWLALKQAGLLLPFLDKKYGGRKGSQFEIQEVLRIAGHYGVPVXXXXXXEGALVLQPLQEFGDEAQIAQGLDMVFKGEGGGLGVTEPETSGAAIAREMQSYYEYTDGQTIYVNAAKYWQGNSQSDFLLVAAKERKNGKLAKVIDLLLVPKTYIRCETLASEGLRAVRYAVNRIDAEMPATAVMKLSQSDAAGLRAFQNIFIRSRLQLIGMTHGIMEYTLENLERYVRNDIRFVDYERREIRRRHQVSEILYRYVCHSVSPVAPVAHQLMEANIVKTLATEYTYAAAQMLQKLLGAKGFERGHTAGNIAIDIRPFTIFEGPNDMLYAEIYDQFVRATAEEKEAGMKLDKNQTLLDRLQTDARFAAVARDYTLPEDIRSFLQEHTLTDACALQKVFIGKIIARLFVFVQAEHEDTAAFLLNDIRKDILDCRYCG

SEQ ID NO: 1560 - protein, 286 aa, Neisseria
MMMVLALGMSMPVSMMVEQSNTLNLCCKKSRMTCSSSRSRSCPCATPIRASGSRVSSRSRIFSIVSTSLCRKNTCPPRLSSRNTASRTLPSLNGLTKVFTARRRLGAVVISEKSRRPSSAMLRVRGIGVAVMVRMSTLARRRLSCSFCRTPKRCSSSIINKPKFLNFMSSCTNLCVPITISTVPSAMPSSVALVALLLLKRERLATFTGKSAKRSAKFCACCSTRSVVGASTATCLPPITATNAARRATSVLPKPTSPHTSRSIGFACVKSLITAAMAAAWSSVSS

SEQ ID NO: 1561 - protein, 285 aa, Neisseria
MMMVLALGISIPVSMMVEQSNTLNRCCKKSRMTCSSSRSRSCPCATPMRASGSRVSSRSRIFSIVSTSLCRKNTCPPRLSSRNTASRTLPSLKGLTKVLTARRRLGAVVISEKSRSPSNAILKVRGIGVAVMVRISTLARRRLSCSFRTPKRCSSSIITKPKFLNLMSSCTSLCVPITISTVPSAMPSSAALVALLLLKRERLATFTGKSAKRSAKFCACCSTKSVVGASTATCLPPITATNAARRATSVLPKPTSPHTRRSIGFACVKSLITAAMAAAWSSVSS

SEQ ID NO: 1562 - protein, 285 aa, Neisseria
MMMVLALGMSIPVSMMVEQSNTLNRCCKKSRMTCSSSRSRSCPCATPMRASGSRVSSRSRMFSMVSTSLCRKNTCPPRLSSRNTASRTLPSLNGLTKVLTARRRLGAVVISEKSRSPSSAILKVRGIGVAVMVRMSTLARRRLSCSFRTPKRCSSSIITKPTFLNFMSSCTSLCVPITISTVPSAMPSSAALVALLLLKRERLATFTGKSAKRSAKFCACCSTRSVVGASTATCLPPITATNAARRATSVLPKPTSPHTRRSIGFACVKSLITAAMAAAWSSVSS

SEQ ID NO: 1563 - protein, 103 aa, Neisseria
MQRLAADGIQIFFVGVDGQFALRINGLVKERARSVFFGKVCRCFEQVILYGFKGTVGQTERGTVAVADTVFRQIVGVVDDTDAERTAVHSRGTRGFYRISLII

SEQ ID NO: 1564 - protein, 103 aa, Neisseria
MQRLAADGIQIFFVSVDGQFALRINGLVKERARTVFFGKVCRCFEQVILYGFKGTVGQTERGTVAVADTVFRQIISIVNHADAERTAAHSRGTRGFYRISLII

SEQ ID NO: 1565 - protein, 103 aa, Neisseria
VQRLVTHSVQVFFVGVDGQFALRINGLVKERARTVFFGKVCRCFEQVILYGFKGTVGQTERGAVAVADTVFRQIIRIVDHADTERTAAHSGGTRGFYRISLII

SEQ ID NO: 1566 - protein, 211 aa, Neisseria
MNRRNARIERAVRIAVIDVLNVDAPGPGTLLHQRGKQVGSRNDTLAYVRVLLVFRIEPLKFVLVGKKRFVQPRNLVGRKQRNVAALNQAGVQQAVDLHAIIKLADTVVFHAPVVFQHQQAFGFNMPQGVEQGCRAAAHATLRTRFDRRLKHLKEGNAAGMPGFTAPDFAVQPADTSGIDADARALGNVFHNRAGSGIDGIQTIVAFNQHTA

SEQ ID NO: 1567 - protein, 211 aa, Neisseria
MNRRDARIERAVRIAVIDVLNVDAPGSGTLLHQRGKQVGSRNDALADIRVLLVFRIEPLKFVLVGKKRFVQSRNLVGRKQRNVAALNQAGVQQAVDLHAVIKLTDTVVFHTAVVFQHQQAFGFDMPQGVEQGCRAAAHAALRTGFDRRLKHFKEGNAAGMPRFAAPDFAVQTADTSGIDADARTLGNVFHNRAGSGIDGIQTIVAFNQHTA

SEQ ID NO: 1568 - protein, 211 aa, Neisseria
MNRRNARIERAVRIAVIDVLNVDAPGSGTLLHQRGKQVGSRNDALADIRVLLVFRIEPLKFVLVGKKRFVQSRNLVGRKQRNVAALNQAGVQQAVDLHAVIKLTDTVVFHAPVVFQHQQAFGFDMPQGVEQGCRAAAHATLRTGFDCRLKHFKEGNAAGMPCFAAPDFAVQSADTSGIDADARTLGNVFHNRAGSGVDGIQAVVAFDQYAA

SEQ ID NO: 1569 - protein, 103 aa, Neisseria
MLAILLSAILGLVSTTAAAGTSEPAHRHTKHISKANKQMLHPECRKYLERRAAWYRSQGNVQELRENKKARKAFRTLPYAEQKIQCRAAYEAFDDFDGGRFRR

SEQ ID NO: 1570 - protein, 103 aa, Neisseria
MLAILLSAILGLVSTTAAAGTSEPAHRDTKHIRKANKQMLHPECRKYLERRAAWYRSQGNVQELRENKKARKAFRSLPYAEQKIQCRAAYEAFDDFDGGSFRR

SEQ ID NO: 1571 - protein, 103 aa, Neisseria
MLAILLSAILGLVSTTAAAGTSEPAHRDTKHIRKANKQMLHPECRKYLERRAAWYRSQGNVQELRENKKARKAFRSLPYKEQKTQCRAAYEAFDDFDGSRFRR

SEQ ID NO: 1572 - protein, 465 aa, Neisseria
MSKLKTIALTASGLSVCPGFLYAQNTSSHQVGLAIMRLNSSILDLPPTKQYFQSGSLWDELRQGFRMGEVNPELVRRHESKFIASRSYFDRVVNRSRPYMYHIANEVKKRNMPAEAALLPFIESAFVTKAKSHVGASGLWQFMPATGRHYGLEKTPVYDGRHDVYAATDAALNYLQYLYGLFGDWPLAFAAYNWGEGNVGRAVNRARDQGLEPTYENLRMPNETRNYVPKLLAVRNIIATPQSFGMNISDIDNKPYFQAVEPGRPLDNEAIARLAGITQSELLALNPAFNVPAFIPKNKRKLLLPVASVQTFQSNYLNAAPDSLFSWEVYTPAAKTSLSDISTATGMSIADIKRLNNLNGNLVNAGRSILVAKNGKTLHTASESVVSIDIDNTPDTYRSNMPAGTVNVSIARIQPAAAQTADITVAPLPQETVRTGTRSPCPHYRTRPCDSRSATSNRKTDCHAV

SEQ ID NO: 1573 - protein, 465 aa, Neisseria
  VARIANT (1)...(465): Xaa = Any Amino Acid
MSKLKTIALTASGLSVCPGFLYAQNTSSHQIGLAIMRLNSSILDLPPTKQYFQSGSLWGELRQGFRMGEVNPELVRRHESKFIASHSYFNRVINRSRPYMYHIANEVKKRNMPAEAALLPFIESAFVTKAKSHVGASGLWQFMPATGRHYGLEKTPVYDGRHDVYAATDAALNYLQYLYGLFGDWPLAFAAYNWGEGNVGRAINRARAQGLEPTYENLRMPNETRNYVPKLLAVRNIIATPQSFGMNISDIDNKPYFQAVEPDRPLDNEAIARLAGITQSELLALNPAFNVPAFIPKSKRKLLLPVASVQTFQSNYLNAAPDSLFSWEVYTPAAKTSLSDISTATGMSIADIKRLNNLNGNLVNAGRSILVAKNGKTLQTASESVVSIDIDNTPDTYRSNMPAGTVNVGIARIRPAAAQTADITVAPLPQKTVRTXTRSPCPYCRTCPCDSRSATSNRKTDRHAV

SEQ ID NO: 1574 - protein, 465 aa, Neisseria
  VARIANT (1)...(465): Xaa = Any Amino Acid
MSKLKTIALTASGLSVCPGFLYAQNTSSHQIGLAIMRLNSSILDLPPTKQYFQSGSLWSELRQGFRMGEVNPELVRRHESKFIASHSYFNRVINRSRPYMYHIANEVKKRNMPAEAALLPFIESAFVTKAKSHVGASGLWQFMPATGRHYGLEKTPVYDGRHDIYAATDAALNYLQYLYGLFGDWPLAFAAYNWGEGNVGRAINRARAQGLEPTYENLRMPNETRNYVPKLLAVRNIIAAPQSFGMNISDIDNKPYFQAVEPDRPLDNEAIARLAGITQSELLALNPAFNVPAFIPKSKRKLLLPVASVQTFQSNYLNAAPDSLFSWEVYTPAAKTSLSDISTATGMSIADIKRLNNLNGNLVNAGRSILVAKNGKTLQTASESVVSIDIDNTPNTYRSNMPAGTVNVGIARIRPAAAQTADITVAPLPQKTVRTXTRSPCPYCRTCPCDSRSATSNRKTDRHAV

SEQ ID NO: 1575 - protein, 335 aa, Neisseria
MIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEAAEAAGYKAGEDVLFALDCASSEFYKDGKYHLEAEGRSYTNAEFAEYLEGLVNEFPIISIEDGMDENDWEGWKLLTEKLGKKVQLVGDDLFVTNPKILAEGIEKGVANALLVKVNQIGTLSETLKAVDLAKCNRYASVMSHRSGETEDSTIADLAVATNCMQIKTGSLSRSDRMAKYNQLLRIEEELAEAAYYPGKAAFYQLGK

SEQ ID NO: 1576 - protein, 335 aa, Neisseria
MIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEATEAAGYKAGEDVLFALDCASSEFYKDGKYHLEAEGRSYTNAEFAEYLEGLVNEFPIISIEDGMDENDWEGWKLLTEKLGGRVQLVGDDLFVTNPKILAEGIEKGVANALLVKVNQIGTLSETLKAVDLAKRNRYASVMSHRSGETEDSTIADLAVATNCMQIKTGSLSRSDRMAKYNQLLRIEEELAEAADYPSKAAFYQLGK

SEQ ID NO: 1577 - protein, 335 aa, Neisseria
MIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEATEAAGYKAGEDVLFALDCASSEFYKDGKYHLEAEGRSYTNAEFAEYLEGLVNEFPIISIEDGMDENDWEGWKLLTEKLGGKVQLVGDDLFVTNPKILAEGIEKGVANALLVKVNQIGTLSETLKAVDLAKRNRYASVMSHRSGETEDSTIADLAVATNCMQIKTGSLSRSDRMAKYNQLLRIEEELAEAADYPSKAAFYQLGK

SEQ ID NO: 1578 - protein, 428 aa, Neisseria
MSAIVDIFAREILDSRGNPTVECDVLLESGVMGRAAVPSGASTGQKEALELRDGDKSRYSGKGVLKAVEHVNNQIAQALIGIDANEQSYIDQIMIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEAAEAAGYKAGEDVLFALDCASSEFYKDGKYHLEAEGRSYTNAEFAEYLEGLVNEFPIISIEDGMDENDWEGWKLLTEKLGKKVQLVGDDLFVTNPKILAEGIEKGVANALLVKVNQIGTLSETLKAVDLAKCNRYASVMSHRSGETEDSTIADLAVATNCMQIKTGSLSRSDRMAKYNQLLRIEEELAEAAYYPGKAAFYQLGK

SEQ ID NO: 1579 - protein, 428 aa, Neisseria
MSAIVDIFAREILDSRGNPTVECDVLLESGVMGRAAVPSGASTGQKEALELRDGDKSRYSGKGVLKAVEHVNNQIAQALIGIDANEQSYIDQIMIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEATEAAGYKAGEDVLFALDCASSEFYKDGKYHLEAEGRSYTNAEFAEYLEGLVNEFPIISIEDGMDENDWEGWKLLTEKLGGRVQLVGDDLFVTNPKILAEGIEKGVANALLVKVNQIGTLSETLKAVDLAKRNRYASVMSHRSGETEDSTIADLAVATNCMQIKTGSLSRSDRMAKYNQLLRIEEELAEAADYPSKAAFYQLGK

SEQ ID NO: 1580 - protein, 428 aa, Neisseria [sequence omitted]

SEQ ID NO: 1581 - protein, 163 aa, Neisseria
MAAEPMRMPEVTYGFSGSFGMAFLLTVMCALPKAASAALPVIFIGCRSTRKTWLSVRPETMRKPRLTNSSAMTAALIFTCFAYCLNSGCNASLNATALAAITCINGPPCRLGKMEEFSAFSWVLSRHKITPPRGPRRVLWVVVVTKSQNGTGLGYSPPATSPA

SEQ ID NO: 1582 - protein, 163 aa, Neisseria
MAAEPMRMPEVTKGFSGSFGMAFLLTVMCALPKAASAALPVIFIGCRSTRKTWLSVRPETMRKPRLTNSSAMAAALIFTCFAYCLNSGCNASLNATALAAITCISGPPCRLGKMEEFNAFSWVLSRHKITPPRGPRRVLWVVVVTKSQNGTGLGYSPPATRPA

SEQ ID NO: 1583 - protein, 163 aa, Neisseria; identical to SEQ ID NO: 1582

SEQ ID NO: 1584 - protein, 144 aa, Neisseria
MPRFSGSISSMISIARTFGAPESVPAGKVAARMSILVTPSFKQPSTLETMCITWEYFSITILSVTLTSPVLLMRPTSLRPKSISITCSAISLASLNKSCSLARSSAGVLPRRRVPAMGRTMTSSRSRRTRISGEEPTMWKSPKS

SEQ ID NO: 1585 - protein, 144 aa, Neisseria
MPRLLGSTSSMISMARTLGAPESVPAGKVAARMSMLVMPSFRRPSTLETMCITWEYFSITILSVTLTSPVLLMRPTSLRPKSINMTCSAISLASLNKSCSLARSSAGVLPRRRVPAMGRTITSLRSRRTRISGEEPTMWKSPKS

SEQ ID NO: 1586 - protein, 144 aa, Neisseria
MPRLLGSTSSMISMARTLGAPESVPAGKVAARMSMLVMPSFRRPSTLETMCITWEYFSITILSVTLTSPVLLMRPTSLRPKSINMTCSAISLASLNKSCSLARSSAGVLPRRRVPAMGRTMTSSRSRRTRISGEEPTMWKSPKS

SEQ ID NO: 1587 - protein, 378 aa, Neisseria
MNTPPILPPAMLGILGGGQLGRMFAVAAKTMGYKVTVLDPDPNAPAAEFADRHLCAPFDDRAALDELAKCAAVTTEFENVNADAMRSLAKHTNVSPSGDCVSIAQNRIQEKAWIRKAGLQTAPYQAVCKAEDITEASAQFLPGILKTATLGYDGKGQIRVKTLDELKAAFAEHGGVDCVLEKMVDLRGEISVIVCRLNDENVQTFDPAENIHENGILAYSIVPARLSADVQQQARQTAQRLADELDYVGVLAVEMFVVGDTHELLVNETAPRTHNSGHHTIDACAADQFQQQVRIMCNLPPADTKLLSPCCMANILGDVWQEDGGEPDWLPLQSRPNAHLHLYGKKTAQKGRKMGHFTVLTTDSDTAFQEAKKLHQSL

SEQ ID NO: 1588 - protein, 378 aa, Neisseria
MKNISLSPPAMLGILGGGQLGRMFTVAAKTMGYKVTVLDPDPDAPAAEFADRHLCAPFNDQAALDELAKCAAVTTEFENVNADAMRFLAKHTNVSPSGDCVAIAQNRIQEKAWIRKAGLQTAPYQVVCKAEDITEASAQFLPGILKTATLGYDGKGQIRVKTLDELKAAFAEHGGVDCVLEKMVDLRSEISVIVCRLNNDNVQTFDPAENIHENGILAYSIVPARLSADVQQQARQMAQRLADELDYVGVLAVEMFVVGDTHELVVNEIAPRPHNSGHHTIDACAADQFQQQVRIMCNLPPADTKLLSSCCMANILGDVWQEDGGEPDWLPLQSHPNAHLHLYGKKTAHKGRKMGHFTVLTTDSDTAFQEAKKLHQSL

SEQ ID NO: 1589 - protein, 378 aa, Neisseria
MKNISLSPPAMLGILGGGQLGRMFTVAAKTMGYKVTVLDPNPNAPAAEFADRHLCAPFDNQTALEELAKCAAVTTEFENVNADAMRFLAKHTNVSPSGDCVAIAQNRIQEKAWIRKAGLQTAPYQAICKAEDITEESIQFLPGILKTATLGYDGKGQIRVKTVDELKAAFAEHRGVDCVLEKMVDLRGEISVIVCRLNNDNVQTFDPAENIHENGILAYSIVPARLSADIQQQARQMAQRLADELNYVGVLAVEMFVVGDTHELVVNEIAPRPHNSGHHTVDACAADQFQQQVRLMCNLPPADTKLLSSCCMANILGDVWQEDGGEPDWFPLQSRPDAHLHLYGKKTAHKGRKMGHFTILSTDSDTAFQEAKKLHQSL

SEQ ID NO: 1590 - protein, 259 aa, Neisseria
MVAGIVRARGGFIDEQFMCVADNKHFYRQYADIIQFVRQALRRLPRLLLHVGTQPRGDDGISQDAVFVDVFGGVEGLHVFIVQTAYDHGNLAAQVHHFFQNAIHAAVFGKRGFEFVQRFDADLTFAVVAQRSRFQDAGQKLRACFSNVFGLANRLIRRGLQACFAYPRFFLNAVLCNGHAVAAGGNVGMLCQRAHRVGIDVFKFGRNRRAFCQFVQRGPVVKRRAQMAVGKFRRRRIRVGIENGYFVAHGFSGNGKHSA

SEQ ID NO: 1591 - protein, 259 aa, Neisseria
MVSGIVRARGDFVDDQFMRVTDNKHFYRQYADIIQFVRQALRHLPRLLLHVGTQSRGDDGISQDAVFVDVFGRVESLHVVIVQTAYDYGNFTAQIHHFFQNAIHAAVFGKRGFEFIQCFYADLTFAVVAQRSRFQDAGQKLRACFSDVFSLTNHLIRRGLQSRFAYPCLFLNAVLCNRHTIAARGNIGMFCQKAHRIGIDVFKFSGHRRAFCQFVQSSLVVKRRAQMAVGKFCCRRVRIGVENGYFVAHGFGGNGKHSA

SEQ ID NO: 1592 - protein, 259 aa, Neisseria
MVAGIVRTRRDFVDDQFMRVADNKHFYRQYADVVQFIGQTLRHLSRLLLNVGTQSGWDDGVGEDTVFVNVFGRIESLHVVIVQTAYDNGNFAAQVHHFFQNAIHAAVFGKRGFEFIHRFDADLAFAVIAQCSGFQDAGQKLYAFFSDVFGFANCLIRRGLQACFAYPCLFLNAVLRDGNAVAAGGNIGMFGEKTHRIGIDVFELGRNSRTFCQFFQSGLVVKRRTQMAVGKFRCRRIRVGIEYGYFVAHGFGSNSKHSA

SEQ ID NO: 1593 - protein, 298 aa, Neisseria
  VARIANT (1)...(298): Xaa = Any Amino Acid
MHIGGYFIDNPIALAPMAGIADKPFRRLCRAFGAGWAVCEMLASDPTLRNTGKTLHRSDFADEGGIVAVQIAGSDPEQMADAARYNVGLGAQVIDINMGCPAKKVCNVQAGSALMQDEPLVAAILEAVVKAAGVPVTLKTRLGWHDDDQNLPAVAKIAEDCGIAALAVPRARAHANVQRRGALRTHRRDQKPSEHPGLGQRRHHFAAKSRRRPQTNRRRRHHDRARRARQAVVFPRFEALCRTRRFTACLEFGRMQSRHFEPHPRHARVLWXDRRCAHRTQTHRLVHRRNARRRTGAA

SEQ ID NO: 1594 - protein, 298 aa, Neisseria
  VARIANT (1)...(298): Xaa = Any Amino Acid
MHIGGYFIDNPIALAPMAGITDKPFRRLCRDFGAGWAVCEMLTSDPTLRNTRKTLHRSDFADEGGIVAVQIAGSDPQQMADAARYNVSLGAQLIDINMGCPAKKVCNVQAGSALMQNEPLVAAILEAVVRAAGVPVTLKTRLGWHDDHQNLPVIAKIAEDCGIAALAVXRTHAYANVQRRSALRTHRRNQMPSEHPGLGQRRHYFAAKSPSRPQTNRRRRHYDRARRARQAVVLPRFETLCRTRCFAACLEFGRMRRRYFEPHPRHTRVLRRHRRCAHRTQTHRLVHRRNARRRTDTS

SEQ ID NO: 1595 - protein, 298 aa, Neisseria
  VARIANT (1)...(298): Xaa = Any Amino Acid
MHIGGYFIDNPIALAPMAGITDKPFRRLCRDFGAGWAVCEMLTSDPTLRNTRKTLHRSDFADEGGIVAVQIAGSDPQQMADAARYNVSLGAQLIDINMGCPAKKVCNVQAGSALMQNEPLVAAILEAVVKAAGVPVTLKTRLGWHDDHQNLPVIAKIAEDCGIAALAXPRTHAHANVQRRSGLRPDCRNQMPSEHPGLGQRRHYLAAKSPSRPQTNRRRRHYDRARRARQTVVLPRFETLRRTRCFTACLEFGRMYRHYFEPHPSHARVLRRHRRCAHRTQTHRLVHRRNARRRTDTS

SEQ ID NO: 1596 - protein, 293 aa, Neisseria
MCTEMKFIFFVLYVLQFLPFALLHKIAGLIGSLAYLLVKPRRRIGEINLAKCFPEWDEEKRKTVLKQHFKHMAKLMLEYGLYWYASAKCLKSLVRYRNKHYLDDALAAGEKVIILYPHFTAFEMAVYALNQDVPLISMYSHQKNKILDEQILKGRNRYHNVFLIGRTEGLRALVKQFRKSSAPFLYLPDQDFGRNNSVFVDFFGIQTATITGLSRIAALANAKVIPAIPVREADNTVTLQFYPAWKSFPSEDAQADAQRMNRFIEERVREHPEQYFWLHKRFKTRPEGSPDFY

SEQ ID NO: 1597 - protein, 293 aa, Neisseria
MCIEMKFIFFVLYVLQFLPFALLHKIADLTGLLAYLLVKPRRRIGEINLAKCFSEWSEEKRKTVLKQHFKHMAKLMLEYGLYWYAPAGRLKSLVRYRNKHYLDDALAAGEKVIILYPHFTAFEMAVYALNQDIPLISMYSHQKNKILDEQILKGRNRYHNVFLIGRTEGLRALVKQFRKSSAPFLYLPDQDFGRNDSVFVDFFGIQTATITGLSRIAALANAKVIPAIPVREADNTVTLHFYPAWKSFPGEDAKADAQRMNRFIEDRVREHPEQYFWLHKRFKTRPEGSPDFY

SEQ ID NO: 1598 - protein, 293 aa, Neisseria
MCIEMKFIFFVLYVLQFLPFALLHKLADLTGLLAYLLVKPRRRIGEINLAKCFPEWDGKKRKTVLKQHFKHMAKLMLEYGLYWYAPAGRLKSLVRYRNKHYLDDALAAGEKVIILYPHFTAFEMAVYALNQDVPLISMYSHQKNKILDEQILKGRNRYHNVFLIGRTEGLRALVKQFRKSSAPFLYLPDQDFGRNDSVFVDFFGIRTATITGLSRIAALANAKVIPAIPVREADNTVTLHFYPAWESFPSEDAQADAQRMNRFIEERVREHPEQYFWLHKRFKTRPEGSPDFY

SEQ ID NO: 1599 - protein, 183 aa, Neisseria
MIHPHHFRAFFINGHGVEIVHLLIADGAHRMGGRACVFGELVLAQQADVLDAAHGAAGAVAGKLLVAEHGQPFLQRKLEPVAAGYAVARPVVEIFVSDHGFNAFEIGIGGGAAVGEDELGVKNVQTLVFHRAHIEIAYGDDHENIQVIFQPEARFVPLHRVFSTIPRQSRPWVCPLRWCKTRF

SEQ ID NO: 1600 - protein, 183 aa, Neisseria
  VARIANT (1)...(183): Xaa = Any Amino Acid
VIHPHYFRAFFINGHGVEIVHLLIAGGAHRMGGRACVFGELVLAQQADVFDAAHGAAGAVAGKFLVAEHGQPFLQRKLEPVAAGYAVARPVVEILVSDHGFDAFEIGIGGGAAVGKDELGVKDVQTLVFHRAHIEIAHGDDHENIQVVFQTEARFVPFHRVFXTIPRQSRPWACPLRWCKTRF

SEQ ID NO: 1601 - protein, 183 aa, Neisseria
  VARIANT (1)...(183): Xaa = Any Amino Acid
VIHPHHFRAFFINGHGVEIVHLLISGGAHRMCGRTCVFGELVLAQQADVFDTAHGAAGAVAGKFLVAEHGQPFLQRKLEPVAAGHAVARPVVEIFVSDHGFDAFKIGIGGGTAVGKDELGVKDVQTLVFHRTHIEIAHGDDHENIQVVFQTEARFVPLHCVFXAIPRQSRPWACPLRWCKTRF

SEQ ID NO: 1602 - protein, 638 aa, Neisseria
MKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRAGRAVRRIENIRLLRQNQFPEDAGPTAHPVRPVSYEEMNNFYTMTVYEKGAEVVRMYHTLLGEEGFQKGMKLYFQRHDGQAVTCDDFRAAMADANGINLDQFALWYSQAGTPVLEAEGRLKNNVFELTIKQTVPPTPDMADKQPMMIPVKVGLLNRNGEAVAFDYQGKRATEAVLLMTEAEQAFPLEGVTEAVVPSLLRGFSAPVYLNYPYSDDDLLLLLAHDSDAFTCWEAAQTLYRRAVAANLAALSDGIGLPKHEKLLAAVEKVISDDLLDNAFKALLLGVPSEAELWDGTENIDPLRYHQAREALLDTLAVRFLPKWHELDRQAAKQENQSYEYSPETADWRTLRNVCRAFVLRADPAHIETVAEKYGEMAQNMTHEWGILSAVNGNESDTRNCLLAQFADKFSDDALVMDKYFALIGSSRRSDTLQQVQTALQHPKFSLENPNKARSLIGSFSRNVPHFHAQDGSGYRFIADKVIEIDRFNPQVAARLVQAFNLCNKLEPHRKNLVKQELQCIRAQEGLSKDVGEIVGKILG

SEQ ID NO: 1603 - protein, 638 aa, Neisseria
MKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRASRAVRRIENIRLLRQHQFPEDAGPTAHPVRPASYEEMNNFYTMTVYEKGAEVVRMYHTLLGEEGFQKGMKLYFQRHDGQAVTCDDFRAAMADANGINLDQFALWYSQAGTPVLEAEGRLKNNIFELTVKQTVPPTPDMTDKQPMMIPVKVGLLNRNGEAVAFDYQGKRATEAVLLLTEAEQTFLLEGVTEAVVPSLLRGFSAPVHLNYPYSDDDLLLLLAHDSDAFTRWEAAQTLYRRAVAANLATLSDGVELPKHEKLLAAVEKVISDDLLDNAFKALLLGVPSEAELWDGAENIDPLRYHQAREALLDTLAVHFLPKWHELNRQAAKQENQSYEYSPEAAGWRTLRNVCRAFVLRADPAHIETVAEKYGEMAQNMTHEWGILSAVNGNESDTRNRLLAQFADKFSDDALVMDKYFALVGSSRRSDTLQQVRTALQHPKFSLENPNKARSLIGSFSRNVPHFHAEDGSGYRFIADKVIEIDRFNPQVAARLVQAFNLCNKLEPHRKNLVKQALQRIRAQEGLSKDVGEIVGKILD

SEQ ID NO: 1604 - protein, 638 aa, Neisseria
MKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRASRAVRRIENIRLLRQHQFPEDAGPTAHPVRPARYEEMNNFYTMTVYEKGAEVVRMYHTLLGEEGFQKGMKLYFQRHDGQAVTCDDFRAAMVDANGINLDQFALWYSQAGTPVLDAQGRLKNNVFELTIKQTVPPTPDMADKQPMMIPVKIGLLNCNGEAVAFDYQGKRATEAVLLLTEAEQTFQFESVTEAVVPSLLRGFSAPVHLNYPYSDDDLLLLLAHDSDAFTRWEAAQTLYRRAVAANLAALSDGVELPKHEKLLAAVEKVISDDLLDNAFKALLLGVPSEAELWDGAENIDPLRYHQAREALLDILAVRFLPKWHELNRQAAKQENQSYEYSPEAAGWRTLRNVCRAFVLRADPAHIETVAEKYAEMAQNMTHEWGILSAVNGNESDTRNRLLAQFADKFSDDALVMDKYFALVGSSRRSDTLQQVQTALQHPKFSLENPNKARSLIGSFSRNVPHFHAEDGSGYRFIADKVIEIDRFNPQVAARLVQAFNLCNKLEPHRKNLVKQALQRIRAQEGLSKDVGEIVGKILD

SEQ ID NO: 1605 - protein, 867 aa, Neisseria
MSKTVRYLKDYQTPAYRILETELHFDIAEPQTVVKSRLTVEPQRAGEPLVLDGSAKLLSVKINGAAADYVLEGETLTIADVPSERFTVEVETEILPAENKSLMGLYASGGNLFTQCEPEGFRKITFYIDRPDVMSKFTTTIVADKKRYPVLLSNGNKIDGGEFSDGRHWVKWEDPFAKPSYLFALVAGDLAVTEDRFTTMSGRNVKIEFYTTEADKPKVGFAVESLKNAMKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRAGRAVRRIENIRLLRQNQFPEDAGPTAHPVRPVSYEEMNNFYTMTVYEKGAEVVRMYHTLLGEEGFQKGMKLYFQRHDGQAVTCDDFRAAMADANGINLDQFALWYSQAGTPVLEAEGRLKNNVFELTIKQTVPPTPDMADKQPMMIPVKVGLLNRNGEAVAFDYQGKRATEAVLLMTEAEQAFPLEGVTEAVVPSLLRGFSAPVYLNYPYSDDDLLLLLAHDSDAFTCWEAAQTLYRRAVAANLAALSDGIGLPKHEKLLAAVEKVISDDLLDNAFKALLLGVPSEAELWDGTENIDPLRYHQAREALLDTLAVRFLPKWHELDRQAAKQENQSYEYSPETADWRTLRNVCRAFVLRADPAHIETVAEKYGEMAQNMTHEWGILSAVNGNESDTRNCLLAQFADKFSDDALVMDKYFALIGSSRRSDTLQQVQTALQHPKFSLENPNKARSLIGSFSRNVPHFHAQDGSGYRFIADKVIEIDRFNPQVAARLVQAFNLCNKLEPHRKNLVKQELQCIRAQEGLSKDVGEIVGKILG

SEQ ID NO: 1606 - protein, 867 aa, Neisseria
MSKTVHYLKDYQTPAYHILKTDLHFDINEPQTVVKSRLTVEPQRVGEPLVLDGSAKLLSVKINGAAADYVLEGETLTIAGVPSERFTVEVETEILPAENKSLMGLYASGGNLFTQCEPEGFRKITFYIDRPDVMSKFTTTIVADKKRYPVLLSNGNKIDGGEFSDGRHWVKWEDPFSKPSYLFALVAGDLAVTEDYFTTMSGRNVKIEFYTTEADKPKVGFAVESLKNAMKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRASRAVRRIENIRLLRQHQFPEDAGPTAHPVRPASYEEMNNFYTMTVYEKGAEVVRMYHTLLGEEGFQKGMKLYFQRHDGQAVTCDDFRAAMADANGINLDQFALWYSQAGTPVLEAEGRLKNNIFELTVKQTVPPTPDMTDKQPMMIPVKVGLLNRNGEAVAFDYQGKRATEAVLLLTEAEQTFLLEGVTEAVVPSLLRGFSAPVHLNYPYSDDDLLLLLAHDSDAFTRWEAAQTLYRRAVAANLATLSDGVELPKHEKLLAAVEKVISDDLLDNAFKALLLGVPSEAELWDGAENIDPLRYHQAREALLDTLAVHFLPKWHELNRQAAKQENQSYEYSPEAAGWRTLRNVCRAFVLRADPAHIETVAEKYGEMAQNMTHEWGILSAVNGNESDTRNRLLAQFADKFSDDALVMDKYFALVGSSRRSDTLQQVRTALQHPKFSLENPNKARSLIGSFSRNVPHFHAEDGSGYRFIADKVIEIDRFNPQVAARLVQAFNLCNKLEPHRKNLVKQALQRIRAQEGLSKDVGEIVGKILD

SEQ ID NO: 1607 - protein, 867 aa, Neisseria
MSKTVHYLKDYQTPAYHILKTDLHFDINEPQTIVKSRLTVEPKRVGEPLVLDGSAKLLSVKINGVAADYVLEGETLTIADVPSERFTVEVETEILPAENKSLMGLYASAGNLFTQCEPEGFRKITFYIDRPDVMSKFTTTIVADKKRYPVLLSNGNKIDGGEYSDGRHWVKWEDPFAKPSYLFALVAGDLAVTEDYFTTMSGRNVKIEFYTTEADKPKVGFAVESLKNAMKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRASRAVRRIENIRLLRQHQFPEDAGPTAHPVRPARYEEMNNFYTMTVYEKGAEVVRMYHTLLGEEGFQKGMKLYFQRHDGQAVTCDDFRAAMVDANGINLDQFALWYSQAGTPVLDAQGRLKNNVFELTIKQTVPPTPDMADKQPMMIPVKIGLLNCNGEAVAFDYQGKRATEAVLLLTEAEQTFQFESVTEAVVPSLLRGFSAPVHLNYPYSDDDLLLLLAHDSDAFTRWEAAQTLYRRAVAANLAALSDGVELPKHEKLLAAVEKVISDDLLDNAFKALLLGVPSEAELWDGAENIDPLRYHQAREALLDILAVRFLPKWHELNRQAAKQENQSYEYSPEAAGWRTLRNVCRAFVLRADPAHIETVAEKYAEMAQNMTHEWGILSAVNGNESDTRNRLLAQFADKFSDDALVMDKYFALVGSSRRSDTLQQVQTALQHPKFSLENPNKARSLIGSFSRNVPHFHAEDGSGYRFIADKVIEIDRFNPQVAARLVQAFNLCNKLEPHRKNLVKQALQRIRAQEGLSKDVGEIVGKILD

SEQ ID NO: 1608 - protein, 179 aa, Neisseria
  VARIANT (1)...(179): Xaa = Any Amino Acid
MLCMNYQSNSGEGVLVAKTYLLTALIMSMVISGCQVIHANQGKVNTNSAVIAGADAHTPEHVTGLTEQKQVIASDFIVASANPLATQAGYDILKQGGSAADAMVAVQTTLSLVEPQSSGLGGGAFVLYWDNTAKTLTTFDGRETAPMRATPELFLDKDGXPLKFMEAVVARXVRLLSLN

SEQ ID NO: 1609 - protein, 181 aa, Neisseria
MPCMNHQSNSGEGVLVAKTYLLTALIMSMTISGCQVIHANQGKVNTHSAVITGADAHTPEHATGLTEQKQVIASDFMVASANPLATQAGYDILKQGGSAADAMVAVQTTLSLVEPQSSGLGGGAFVLYWDNTAKTLTTFDGRETAPMRATPELFLDKDGQPLKFMEAVVVVARWVRLLSLN

SEQ ID NO: 1610 - protein, 181 aa, Neisseria; identical to SEQ ID NO: 1609

SEQ ID NO: 1611 - protein, 270 aa, Neisseria
MRFVFCLGGEIVSDPCDFHLVFVRVESAADQTETQIHQIRIHGIGFAIIADFLQRARVERFPHFAAVHTQLARKAAQFRHIVQRHIRPRLVKREQIHQIAVALVITADVVVPLEIAAVAEIAVARIPIARGVDAVYQGAVMQYGQVETAAVPADQLRRMFFNQFEKLGNHDFFAIVHLADGADMNLVLPPAHTAGNRHNLMEVVLHKIAAGLCAAFLLREQHHFVIRQGRRQVIQRTDTLHIGYGFNIESQNRIHGSTLHSKTDLRLLCH

SEQ ID NO: 1612 - protein, 224 aa, Neisseria
MRLFPGLCGQVIPHPFDFHFVFVRIQPAADQTETQVHQISVCRVGFAIIADFLQPARMECLPNLAAVHTQLARKTAQFRHIVQRHVCPRLVKREQIHQIAVALVITADVVVPLEIAAVAEIAVAHIPIARGVDAVYQGAVMQYGQIETAAVPTDQLRRMFFNQFEKFSNDHFLAVIHLADGADMYFILPPTHAARNRHNLMKMMLHKIAARLSTAFVLGNQHHL

SEQ ID NO: 1613 - protein, 269 aa, Neisseria
  VARIANT (1)...(269): Xaa = Any Amino Acid
MRFVFCLGGEIVSDPLDFHFVFVCVESAADQTETQIHQIGIYRIGFAIIADFLQPARVERLPHLAAVHTQLARKTAQFRHIVQRHIRPRLVKREQIHQIAMTLVVAADVVVPLEIAAVAEIAVAHIPIARGVDAVQRTVMQNRQVETAAVPTDQLRRMFFNQLEKFGDNHFLAVIHLADCTDMDFILPPTHAARNRHNLMKMMLHKIPTRLSTAFLLGKQHHFIVGQRGRQVIQRTDTLHIGYGFNIESQNRGHDSTLYLKXDLRLLCH

SEQ ID NO: 1614 - protein, 106 aa, Neisseria
MRRIVKKHQPVNAPHIVLEIRIMKLHRAFVFLGRKRPHHHDRSLRRQHGIEGMGFDFKQIFRHVQSSNRQSGRQPVCTKPPNTASLQTALSRPAVFGYNADIKRIL

SEQ ID NO: 1615 - protein, 106 aa, Neisseria
MRRIIKKHQPINAPHIVLEIRIMKLHRAFVFLGRKRPHHHDSSLRRQHGIEGMGFDFKQIFRHVQSSNRQNGRQPVCTKPPNTASLQTALSRPAVFGYNADIKRIL

SEQ ID NO: 1616 - protein, 106 aa, Neisseria
MRRIIKKHQPVNAPHIVLEIRIMKLHRAFVFLGRKRPHHHDRSLRRQHGIEGMGFDFKQIFRHVQSSNRQNGRQPVCTKPPNTASLQTALSRPAVFGYNADIKRIL

SEQ ID NO: 1617 - protein, 151 aa, Neisseria
MTCCRNCLARSCFGLVKNASGVSSSRICPLSTKITRSATSRANPISWVTHIIVMPLSAKSFITFNTSPTISGSSAEVGSSNSITRGSIASPRAIATRCCWPPESWEGKASFLCASPTRSKSSIAFFSACSAFCPLTFIGARVMLSNTVRCG

SEQ ID NO: 1618 - protein, 151 aa, Neisseria
MTCCRNCLARSCFGLVKNASGVSSSRICPLSTKITRSATSRANPISWVTHIIVMPLSAKSFITFNTSPTISGSSAEVGSSNNITRGSIAKPRAIATRCCWPPESWEGKASFLCASPTRSKSSIAFFSACSAFCPLTFIGARVMFSNTVRCG

SEQ ID NO: 1619 - protein, 150 aa, Neisseria
MTCCRNCLARSCFGLVKNASGVSSSRICPLSTKITRSATSRANPISWVTHIMVIPLSAKSFITFNTSPTISGSSAEVGSSNNITRGSIAKPRAIATRCCWPPESWEGKASFLCASPTRSKSSIAFFSACSAFPLTFIGARVMFSNTVRCG

SEQ ID NO: 1620 - protein, 148 aa, Neisseria
MISRVTIKTPFNAPNTPPKMRLAKPRPTAETAPVSSERSIFWIRQAMTNREMNDRANANRRGWNEAKARSAKGAAKSLAKKKETTHATIEPASAITPRIVEMTMQAAMTAEARRSAMGRLFIRYLAGDAVHAQFVQIAFGIPCVFIVA

SEQ ID NO: 1621 - protein, 148 aa, Neisseria
MTSRVTIKTPFNAPNTPPKMRLAKPKPTAETALVSSERSIFWIRQAMTNREMNDRANANRRGWNEAKARSAKEAAKSLAKKKETTHAAIEPASAITPRIADSTMQAAMTAETRRSAMGRLFIRYLTGDTVYAQFVQIAFGIPCVFIVA

SEQ ID NO: 1622 - protein, 148 aa, Neisseria
MTSRVIIKMPFNAPNTPPKMRLAKPKPTAETAPVSSERSIFWIRQAMTNREMNDRANANRRGWNDAKAMSAKGAAKSLAKKKATTHAAIEPASAITPRIADSTMQAAMMAETRRSATGRLFIRYLTGDTVYAQFVQIAFGIPCVFIVA

SEQ ID NO: 1623 - protein, 208 aa, Neisseria
MRKIRTKICGITTPEDALYAAHAGADALGLVFYPQSPRAIDIIKAQKIAAALPPFVSVVALFVNESAQNIRRILAEVPIHIIQFHGDEDDAFCRQFDRPYIKAIRVQTASDIRNAATRFPNAQALLFDAYHPSEYGGTGHRFDWTLLAEYSGKPWVLAGGLTPENVGEAVRITGAEAVDVSGGVEASKGKKDPAKVAAFIATANRLSR

SEQ ID NO: 1624 - protein, 208 aa, Neisseria
MRKIRTKICGITTPEDAAAAAAAGADAVGLVFFQGSSRAVDIARAKKITAALPPFVSVVALFVNESAQNIRRILAEVPIHIIQFHGDEDDAFCRQFHRPYIKAIRVQTASDIRNAATRFPDAQALLFDAYHPSEYGGTGNRFDWTLLAEYSGKPWVLAGGLTPENVGEAVRITGAESVDVSGGVEASKGKKDAAKVAAFIATANRLSR

SEQ ID NO: 1625 - protein, 208 aa, Neisseria
MRKIRTKICGITTPEDALYAAHAGADALGLVFYPQSPRAVDIIKAQKITAALPPFVSVVALFVNESAQNIRRILAEVPIHIIQFHGDEDDAFCRQFHRPYIKAIRVQTASDIRNAADRFPDAQALLFDAYHPSEYGGTGHRFDWTLLAEYSGKPWVLAGGLTPENVDEAIRITGAEAVDVSGGVEASKGKKDPAKVAAFIATANRLSR

SEQ ID NO: 1626 - protein, 307 aa, Neisseria
MDIETFLAGERAAGGYRCGFVAIVGRPNVGKSTLMNHLIGQKISITSKKAQTTRNRVTGIYTDDTAQFVFVDTPGFQTDHRNALNDRLNQNVTEALGGVDVVVFVVEAMRLTDADRVVLKQLPKHTPVILVINKIDKDKAKDRYALEAFVAQVRAEFEFAAAEAVSAKHGLRIANLLELLKPYLPESVPMYPEDMVTDKSARFLAMEIVREKLFRYLGEELPYAMNVEVEQFEEGDGLNRIYIAVLVDKESQKAILIGKGGERLKKISTEARLDMEKLFDNKVFLKVWVKVKSGWADDIRFLRELGL

SEQ ID NO: 1627 - protein, 307 aa, Neisseria
MDIETFLAGERAAGGYRCGFVAIVGRPNVGKSTLMNHLIGQKISITSKKAQTTRNRVTGIYTDDTAQFVFVDTPGFQTDHRNALNDRLNQNVTEALGGVDVVVFVVEAMRFTDADRVVLKQLPKHTPVILVVNKIDKDKAKDRYALEAFVAQVRAEFEFAAAEAVSAKHGLRIANLLELIKPYLPESVPMYPEDMVTDKSARFLAMEIVREKLFRYLGEELPYAMNVEVEQFEEEDGLNRIYIAVLVDKESQKAILIGKGGERLKKISTEARLDMEKLFDTKVFLKVWVKVKSGWADDIRFLRELGL

SEQ ID NO: 1628 - protein, 307 aa, Neisseria
MDIETFLAGERAADGYRCGFVAIVGRPNVGKSTLMNHLIGQKISITSKKAQTTRNRVTGIYTDDTAQFVFVDTPGFQTDHRNALNDRLNQNVTEALGGVDVVVFVVEAMRFTDADRVVLKQLPKHTPVILVVNKIDKDKAKDRYALEAFVAQVRAEFEFAAAEAVSAKHGLRIANLLELIKPYLPESVPMYPEDMVTDKSARFLAMEIVREKLFRYLGEELPYAMNVEVEQFEEEDGLNRIYIAVLVDKESQKAILIGKGGERLKKISTEARLDMEKLFDTKVFLKVWVKVKSGWADDIRFLRELGL

SEQ ID NO: 1629 - protein, 141 aa, Neisseria
MKTARRRSRELAVQAVYQSLINRTAAPEIAKNIREMSDFAKADEELFNKLFFGTQTNAADYIQKIRPLLDRDEKDLNPIERAVLLTACHELSAMPETPYPVIINEAIEVTKTFGGTDGHKFVNGILDKLAAQIRPDEPKRR

SEQ ID NO: 1630 - protein, 141 aa, Neisseria
MKTARRRSRELAVQAVYQSLINRTAAPEIAKNIREMSDFAKADEELFNKLFFGTQTNAAEYIRQIRPLLDRDEKDLNPIERAVLLTACHELSAMPETPYPVIINEAIEVTKTFGGTDGHKFVNGILDKLAAQIRPDEPKRR

SEQ ID NO: 1631 - protein, 141 aa, Neisseria
MKTARRRSRELAVQAVYQSLINRTAAPEIAKNIREMPDFAKADEELFNKLFFGTQTNAAEYIRQIRPLLDRDEKDLNPIERAVLLTACHELSAMPETPYPVIINEAIEVTKTFGGTDGHKFVNGILDKLAAQIRPDEPKRR

SEQ ID NO: 1632 - protein, 158 aa, Neisseria
MNTIAPNLDGKHLRIGIVQARFTNEIGSQMLKVCCRTLQELGVADENITVATVPGALEIPIALMNFASSEKFDALIAIGVVIRGETYHFELVANESGAGIGRVALDYNIPIANAVLTTENDAQAIERIGEKASDAAKVAVECANLVNLLLEEQFEDEE

SEQ ID NO: 1633 - protein, 158 aa, Neisseria
MNTIAPNLDGKHLRIGIVQARFTNEIGSEMLKVCCRTLQELGVADENITVATVPGALEIPIALMNFASSEKFDALIAIGVVIRGETYHFELVSNESGAGVSRVALDYNIPIANAVLTTENDAQAIERIEEKASDAAKVAVECANLVNLLLEEQFEDEE

SEQ ID NO: 1634 - protein, 158 aa, Neisseria; identical to SEQ ID NO: 1633

SEQ ID NO: 1635 - protein, 198 aa, Neisseria
MPQILVRIFLIRYSFIWETVRLCRFRRHSRSVDFDVFDRKDFNFLTAFRRVQNHFVAFARFNQATRQRRNPRNFVLRGIDFIDADDFDGLLAPVAAQQTDGRAEKYLVGRFAQFGIDDDGSLQTFGQETDAAVDFAHTAFAVKIVAVFAAVAVACRPVDDLDDFGAFFIDQLIKLVFQCLPSGGRNVVFGFGTHIVCG

SEQ ID NO: 1636 - protein, 198 aa, Neisseria
MPQILVRIFLIRYSFIWETARFCRFRRHSRSVDFDVFDRKDFNFLTPFRRVQNHFVAFARFNQTTSQRRNPRNFVLRGIDFIDADDFDGLLAPVVAQQSDRRAEKHLVGRFAQFGIDDDGSLQTFGQETDAAVDFAHTAFAVKIVAVFAAVAVACRPVDDLDDFGAFFVDQLIKLVFQCLPSGGRNVVFGFGTHIVCG

SEQ ID NO: 1637 - protein, 197 aa, Neisseria
MPQILVRIFLIRYSFIWETARLCRFRRHSRSVDFDVFDRKDFNFLTPFRRVNHFVAFTRFNQTTSQRRNPRNFVLRGIDFIDADDFDGLLAPVAAQQTDGRAEKHLVGRFAQFGINDDGGFQTLGQETDAAVDFAHTAFAVKVVAVFAAVAVACRPVDDLDDFGAFFINQLIKLVFQCLPSGGRNVVFGFGTHIVCG

SEQ ID NO: 1638 - protein, 165 aa, Neisseria
MNSLPIADLLASAVIAACIVISTMRGVIAEAGSMVAWVVSFFFAKLFAAPFADLAFASFQPRLFALALSFISLFVIACLIQKMLRSLLTGAVSAVGLGFANRILGGVFGALKGVLIVTLLIMLASKTDLPDTEEWQQSYTVPFFVSLSEAVLNHTDNAPESLDDD

SEQ ID NO: 1639 - protein, 165 aa, Neisseria
MNSLPIADLLVSAVIAACIVLSAMRGVIAEAGSMAAWVVSFFFAKLFAASFADLAFASFQPRLFALALSFISLFVIACLIQKMLRSLLTSAVSAVGLGFANRILGGVFGALKGVLIVTLLVMLASKTDLPDTEEWRQSYTLPFFVSLSEAVLNHSGGTAETPEDD

SEQ ID NO: 1640 - protein, 165 aa, Neisseria
MNNLPVADLLVSAIIAACIVLSAMRGVIAEAGSMAAWVVAFFFAKLFAAPFADIAFASFQPRLFALALSFISLFVIACLIQKILRSLLTGAVSAVGLGFANRILGGVFGALKGILIITLLVMLASKTDLPDTEEWRQSYTLPFFVSLSEAVLNHSGGTAETPEDD

SEQ ID NO: 1641 - protein, 220 aa, Neisseria
MTKGSSAMSSPRAAISVATRTRRLPSLKALSVSSLLCWERSPCIACADRLRRTSSRVTRSTLCLVLQKTITWFICRSTISRSSRLRFWKVSTAMMCCSTLALVVFWAATSTVSGAFMKSCASLRIGAEKVAEKSRVWRWRGSICMILRMSSINPISNMRSASSRTTISALFKLMFFCFTWSSSRPTVATTISQPARRSAVCLSMLTPPKRTVCRSGRFLM

SEQ ID NO: 1642 - protein, 219 aa, Neisseria
MTKGSSAMSSPRAAMSVATRTRRLPSLKALSVSSRLCWERSPCIACADRLRRTSSRVTRSTLCLVLQNTMTWFICKSTISRSSRLRFMVSTAMMCCSTLALVVFCAATSTVSGAFMKSCASLRIGAEKVAEKSRVWRWRGSICMILRMSSIKPISSIRSASSKTTISTLFKWMFFCFTWSSSRPTVATTISQPARRSAVCLSIFIPPNKTVWRSGRFLM

SEQ ID NO: 1643 - protein, 219 aa, Neisseria
MTKGSSAISSPRAAISVATRTRRLPSLKALSVSSRLCWERSPCIACADRLRRTSSRVTRSTLCLVLQNTMTWFICKSTISRSSRLRFMVSTAMMCCSTLALVVSCAATSTVSGAFMKSCASLRIGAEKVAEKSRVWRWRGSICMILRMSSIKPISSIRSASSKTTISTLFKWMFFCFTWSSSRPTVATTISQPARRSAVCLSIFIPPNKTVWRSGRFLM

SEQ ID NO: 1644 - protein, 261 aa, Neisseria
MTTPMAISASNFSEEAKFISAMGISSAPGTVATVMFSSATPNSWRVRQQTLSIWLPISLVKRACTMPMRRCLPSRLGAMVFIGCPLVFGVSECRLKVSVLRLPVGNGLECAVFGKLPRAAFGLGKQCGGFRVGFGDVGEADDAEVVGVVGVFVGFVAAEETPAAVVFKNGGFAVKEADGPVLFGDGVGGDAAVECRGKCLCKCVHCGNTLGGGKLADFTTIPALSADGGGLVVQCAPFAALRCFCIFGVWKRIRAVFCGRR

SEQ ID NO: 1645 - protein, 260 aa, Neisseria
  VARIANT (1)...(260): Xaa = Any Amino Acid
MTTPMAISASNFSEEAKFISAMGISSAPGTVATVMFSSATPNSWRVRQQTLSISLPISLVKRACTMPMRRCLPSRLGAMVFIGCPLVFGVSECRLKVSVLRLPVGDGLECAVFGKLPCAAFGLGEQCGGFRVGFGDVGEADDAEVVRIVGVFVGLVAAEETPAAVVFKNGGFAVEEADGPVLFGDGVGGDTAVECRGKCLCKCVHYGNTLGXKLTDFTTIRALSADGGGLVVQCAPFAALRCFCIFGVWKRIRAVFCGRR

SEQ ID NO: 1646 - protein, 260 aa, Neisseria
  VARIANT (1)...(260): Xaa = Any Amino Acid
ITTPMAISASNFSEEAKFISAMGISSAPGTVATVMFSSATPNSWRVRQQTLSISLPISLVKRACTMPMRRCLPSRLGAMVFIECPLVFGGFGMPSEGSVLRLPVGDGLECAVFCQFPRAAFRLGEQCGGFRVGFGDIGEADDAEVVRVVGVFVGLVAAEETPAAVVFKNGGFAVEEADGLVLFGDGVGGDAAVECRGKCLCKCVHCGNTXGGKLADFTTILALSADGGGLVVQCAPFAALRCFCIFGVWKRIRAVFCGRR

SEQ ID NO: 1647 - protein, 133 aa, Neisseria
MRDFAVWVPYGERRKNWDIRYCLPHLIRLSPTRLRKCGRILSGICEPFCLITPDLTMHYCPILILIDYICVNDEIKMPSEPDWIQTAFCMAGFIRFPTDRPILTRQSGVVRISPRTGFRYPTRSLPKSKKAYG

SEQ ID NO: 1648 - protein, 129 aa, Neisseria
MRDFTVWVSYGKWRKNWDIRYCLLHLIHLSSTRLRKCGRILSGICEPFCLITPDLTMHYCPILILIDYEMAMPSEPDWIQTAFCMAYGFIRFPTDRPIRTRQSGVVRISPRTGFRYPTRSLPKSKKAYG

SEQ ID NO: 1649 - protein, 109 aa, Neisseria
MRDFTVWVSYGKWRKNWDIRYCLLHLIHLSSTRLRKCGRILSGICEPFCLITPDLTMHYCPILILIEYYIRFPTDRPILTRPTGVVRISPRTGFRYPTRSLPKSKKAYG

SEQ ID NO: 1650 - protein, 146 aa, Neisseria
MIKETLMRPIFLSFVLLPILITACSTPDKSARWENIGTISNGNIHTYINKDSVRKNGNLMIFQDKKVVTNLKQERFANTPAYKTAIAEWEIHCNNKTYRLSSLQLFDTKNTEISTQNYTASSLRPMSILSGTLTEKQYETVCGKKL

SEQ ID NO: 1651 - protein, 146 aa, Neisseria
MIKETLMRPIFLSFVLFPILITACSTPDKSARWENIGTISNGNIHTYINKDSVRKNGNLMIFQDKKVVTNLKQERFANTPAYKTAIAEWEIHCNNKTYRLSSLQLFDTKNTEISTQNYTASSLRPMSILSGTLTEKQYETVCGKKL

SEQ ID NO: 1652 - protein, 146 aa, Neisseria
  VARIANT (1)...(146): Xaa = Any Amino Acid
MIKETLMRPIFLSFVLFPILITACSTPDKSARWENIGTISNGNIHTYINKDSVRKNGNLMIFXDKKVVTNLKQERFAXTPAYKTAIAEWEIHCNNKTYRLSSLQLFDTKNTEISTQXYTASSLRPMSILSGTLTEKQYETVCGKKL

SEQ ID NO: 1653 - protein, 172 aa, Neisseria
MRLFPIAAALTLAACGTVQSTQYFVLPDSRYIRPATQGGETAVEVRLAEPLKRGGLVYQTDPYRINTAQNHVWADTLDDMLEAALSNAFNRLDSTRTFVPASRSGSTDKWTVYIDAFQGSYTGKTLISGYAVLPDGTNRPFHIETEQQGDGYAAMTAALEQGLKQAAQQMVE

SEQ ID NO: 1654 - protein, 172 aa, Neisseria
MRLFPIAAALSLAACGTVQSTQYFVLPDSRYIRPATQGGETAVEVRLAEPLKRGGLVYQTDPYRLNTAQNHVWADTLDDMLEAALSNAFNRLDSTRIFVPASRSGSTEKWTVYIDAFQGSYTGKTLISGYAVLPDGTNRPFHIETEQQGDGYAAMTAALEQGLKQAAQQMVE

SEQ ID NO: 1655 - protein, 172 aa, Neisseria
MRLFPIAAALTLAACGTVQSTQYFVLPDSRYIRPATQGGETAVEVRLAEPLKRGGLVYQTDPYRLNTAQNHVWADTLDDMLEAALSNAFNRLDSTRIFVPASRSGSTEKWTVYIDAFQGSYTGKTLISGYAVLPDGTNRPFHIETEQQGDGYAAMTAALEQGLKQAAQQMVE

SEQ ID NO: 1656 - protein, 357 aa, Neisseria
LFCRIGNFAFCGVVSAGCLLNNKHSYSYAKEPHTVKPRFYWAACAVLPAACSPEPAAEKTVSAASQAASTPVATLTVPTARGDAVVPKNPERVAVYDWAALDTLTEPGVNVGATTAPVRVDYLQPAFDKAATVGTLFEPDCESLHRHNPQFVITGGPGAEAYEQLAKNATTIDLTVDNGNIRTSGEKQMETLSRIFGKEARVAELNAQIDALFAQKREAAKGKGRGLVLSVTGNKVSAFGTQSRLASWIHGDIGLPPVDESLRNEGHGQPVSFEYIKEKNPGWIFIIDRTAAIGQEGPAAVEVLDNALVCGTNAWKRKQIIVMPAANYIVAGGARQLIQAAEQLKAAFEKAEPVAAQ

SEQ ID NO: 1657 - protein, 355 aa, Neisseria
LFCRIGNFAFCGVVSAGCLLNNKHSYSYAKEPHTVKPRFYWAACAVLLTACSPEPAAEKTVSAASASAATLTVPTARGDAVVPKNPERVAVYDWAALDTLTELGVNVGATTAPVRVDYLQPAFDKAATVGTLFEPDYEALHRYNPQLVITGGPGAEAYEQLAKNATTIDLTVDNGNIRTSGEKQMETLARIFGKEARAAELKAQIDALFAQTREAAKGKGRGLVLSVTGNKVSAFGTQSRLASWIHGDIGLPPVDESLRNEGHGQPVSFEYIKEKNPDWIFIIDRTAAIGQEGPAAVEVLDNALVRGTNAWKRKQIIVMPAANYIVAGGARQLIQAAEQLKAAFKKAEPVAAGKK

SEQ ID NO: 1658 - protein, 355 aa, Neisseria
LFCRIGNFAFCGVVSAGCLLNNKHSYSYAKEPHTVKPRFYWAACAVLLTACSPEPAAEKTVSAASASAATLTVPTARGDAVVPKNPERVAVYDWAALDTLTELGVNVGATTAPVRVDYLQPAFDKAATVGTLFEPDYEALHRYNPQLVITGGPGAEAYEQLAKNATTIDLTVDNGNIRTSGEKQMETLARIFGKEARAAELKAQIDALFAQTREAAKGKGRGLVLSVTGNKVSAFGTQSRLASWIHGDIGLPPVDESLRNEGHGQPVSFEYIKEKNPDWIFIIDRTAAIGQEGPAAVEVLDNALVRGTNAWKRKQIIVMPAANYIVAGGSRQLIQAAEQLKEAFEKAEPVAAGKE

SEQ ID NO: 1659 - protein, 131 aa, Neisseria
NFSCRADDVFDDICSAVEGFGGIARSVQLGAVSGGAFESVAYSLRQHSAGIVETVGKPLSGAAVVGQVEADILGNAFYVVAVYIPRAFGSGIAAALWPVIAVGGMVFVSVPMDAVKAESVNGTTGFVRIGM

SEQ ID NO: 1660 - protein, 163 aa, Neisseria
  VARIANT (1)...(163): Xaa = Any Amino Acid
MMLKKFVLGGIAALVLAACGGSEGGSGAXXXXNFSCSADDVFNDICSAVEGFGGIARSVQLGAVSGGAFESVAYSLRQHTTGIVETVGKPLSGAAVVGQVEADILGNAFYVVAVYIPRAFGSGIAAALWPVIAVGGMVFVSVPMDAVKAKSVNGTTGFIRIGM

SEQ ID NO: 1661 - protein, 131 aa, Neisseria
NFSCRADDVFDDICSAVESFGGIARSVQLGAVSGGAFESVAYSLRQHTTGIVETVDKPLSGAAVVGQVEADILGNAFYVVAVYIPRAFGSGIAAALWPVIAVGGMVFVSVPMDAVKAESVNGTTGFIRIGM

SEQ ID NO: 1662 - protein, 234 aa, Neisseria
MKSRHLALALGVAALFALAACDSKVQTSVPADSAPAASAAAAPAGLVEGQNYTVLANPIPQQQAGKVEVLEFFGYFCPHCARLEPVLSKHAKSFKDDMYLRTEHVVWQKEMLPLARLAAAVDMAAAESKDVANSHIFDAMVNQKIKLQEPEVLKKWLGEQTAFDGKKVLAAYESPESQARAGKMQELTETFQIDGTPTVIVGGKYKVEFADWESGMNTIDLLADKVREEQKAAQ

SEQ ID NO: 1663 - protein, 232 aa, Neisseria
MKSRHLALGVAALFALAACDSKVQTSVPADSAPAASAAAAPAGLVEGQNYTVLANPIPQQQAGKVEVLEFFGYFCPHCAHLEPVLSKHAKSFKDDMYLRTEHVVWQKEMLTLARLAAAVDMAAADSKDVANSHIFDAMVNQKIKLQNPEVLKKWLGEQTAFDGKKVLAAYESPESQARADKMQELTETFQIDGTPTVIVGGKYKVEFADWESGMNTIDLLADKVREEQKAAQ

SEQ ID NO: 1664 - protein, 232 aa, Neisseria
MKSKHLALGVAALFALAACDSKVQTSVPADSAPAASAAAAPAGLVEGQNYTVLANPIPQQQAGKVEVLEFFGYFCPHCAHLEPVLSKHAKSFKDDMYLRTEHVVWQKEMLTLARLAAAVDMAAADSKDVANSHIFDAMVNQKIKLQEPEVLKKWLGEQTAFDGKKVLAAYESPESQARADKMQELTETFQIDGTPTVIVGGKYKVEFADWESGMNTIDLLADKVREEQKAAH

SEQ ID NO: 1665 - protein, 138 aa, Neisseria
VLHTSRFAQKGSPVNKTLILALSALFSLTACSVERVSLFPSYKLKIIQGNELEPRAVAALRPGMTKDQVLLLLGSPILRDAFHTDRWDYTFNTSRNGIIKERSNLTVYFENGVLVRTEGDALQNAAEALRAKQNADKQ

SEQ ID NO: 1666 - protein, 139 aa, Neisseria
VLHYPSRFAQKGISVNKTLILALSALLGLAACSAERVSLFPSYKLKIIQGNELEPRAVAALRPGMTKDQVLLLLGSPILRDAFHTDRWDYTFNTSRNGIIKERSNLTVYFENGVLVRTEGDVLQNAAEALKDRQNTDKP

SEQ ID NO: 1667 - protein, 139 aa, Neisseria
VLHYPSRFAQKGISVNKTLILALSALLGLAACSVERVSLFPSYKLKIIQGNELEPRAVASLRPGMTKDQVLLLLGSPILRDAFHTDRWDYTFNTSRNGIIKDRSNLTVYFENGVLVRTEGNALQNAAEALRVKQNADKQ

SEQ ID NO: 1668 - protein, 399 aa, Neisseria
SPPLPPMSGKLMAVLMAVLVALMPFSIDAYLPAIPEMAQPLNADIHRIESLSLFMFGTAFGQVAGGAVSDIKGRKPVALTGLIVYCLAVAAIVFASSTEQLLNLRAVQAFGAGMAVVIVGAMVRDYYSGRKAAQMFALIGIILMVVPLAAPMVGALLQGLGGWRAIFVFLAAYSPVLPGLVQYFLPNPAVGGKIGRDVFGLVAGRFKRVLKTRAAMGYLFFQAFSFGSMFAFLTESSFVYRQLYHVTPHRYAWVFALNIITMMFFSRVTAWRLKTGAHPQSILLRGIVVQFAANPSQLAAVLFFGLPPFWLPVACVMFSVGTQGLVGADTQACFMSYFKEEGGSANAVSGVFRSLIGAGVVMAATVMAATMTASASCGIALLWLCSHKAWKENEKKRIL

SEQ ID NO: 1669 - protein, 459 aa, Neisseria
LLIHYIVPVRPVLPGLLLPPVCAGVLKFSVSAYCVFRRRAVCLRIGREFMPSAHYPEMSEKLMAVLMAMLVTLMPFSIDAYLPAIPEMAQSLNADVHRIEQSLSLFMFGTAFGQVVGGSVSDIKGRKPVALTGLIVYCLAVAAIVFVSSAEQLLNLRVVQAFGAGMTVVIVGAMVRDYYSGRKAAQMFALIGIILMVVPLVAPMVGALLQGLGGWQAIFVFLAAYSLVLLGLVQYFLPKPAVGGKIGRDVFGLVAGRFKRVLKTRAAMGYLFFQAFSFGSMFAFLTESSFVYQQLYRVTPHQYAWAFALNIITMMFFNRVTAWRLKTGVHPQSILLWGIVVQFAANLSQLAAVLFFGLPPFWLLVACVMFSVGTQGLVGANTQACFMSYFKEEGGSANAVLGVFQSLIGAGVGMAATFLHDGSATVMAATMTASTSCGIALLWLCSHRAWKENGQSEYL

SEQ ID NO: 1670 - protein, 459 aa, Neisseria
LLIHYIVPVRPVLPGLLLPPVCAGVLKFSVSAYCVFRRRAVCLRIGREFMPSAHYPEMSEKLMAVLMAMLVTLMPFSIDAYLPAIPEMAQSLNADVHRIEQSLSLFMFGTAFGQVVGGSVSDIKGRKPVALTGLAVYCLAVAAIVFASSAEQLLNLRVVQAFGAGMTVVIVGAMVRDYYSGRKAAQMFALIGIILMVVPLVAPMVGALLQGLGGWQAIFVFLAAYSLVLLGLVQYFLPKPAVGGKIGRDVFGLVAGRFKRVLKTRAAMGYLFFQAFSFGSMFAFLTESSFVYQQLYHVTPHQYAWAFALNIITMMFFNRITAWRLKTGVHPQSILLWGIVVQFAANLSQLAAVLFFGLPPFWLLVACVMFSVGTQGLVGANTQACFMSYFKEEGGSANAVLGVFQSLIGAGVGMAATFLHDGSATVMAATMTASTSCGIALLWLCSHRAWKENGQSEYL

SEQ ID NO: 1671 - protein, 269 aa, Neisseria
MKNKTSSLPLWLAAIMLAARSPSKEDKTKENGASAASSSASSASSQTDLQPAASAPDNVKQAESAPLNCTGLHPAAGIGDLIQQIAEHIDSDCLFALSHNELETRFGLPGGGYDNIQRLLFPDIRPEDPDYHQKIMLAIEDLRYGTRTISRQAQDAIMEQERRLREATLMLTQGSQKTRGQGEEPKRARYFEVSATSAYLNRHNNGLGGNFQYIGQLPGYLKMHGEMLENQSLFRLSNRERNPDKPFLDIHFDENGKITRIVVYEKNIY

SEQ ID NO: 1672 - protein, 278 aa, Neisseria
MKNKTSSLLLWLTAIMLTACSPSKDDKTKEVGASAASSSASSAPSQTDLQPTASAPDNVKQAESAPPSNCTSLHPATGIDDLMQQIAEHIDSDCLFALSHHELETRFGLPDGGYDNIQRLLFPDIRPEDPDYHQKIILAIEDLRYGKRTISRQAQNALMEQERRLREATLLLIQGSQETRGQGEEPKRTRYFEVSATPAYSSRHNNGLGGNFQYISQLPGYLKIHGEMLENQSLFRLSNRERNPDKPFLDIHFDENGKITRIVVYEKNIYFNPNTGRI

SEQ ID NO: 1673 - protein, 281 aa, Neisseria
MKNKTSSLLLWLAAMMLTACSPSKEDKTKENGASAASSTASAASSSAPQTDLQPAASAPDNVKQAESVPPSNCTDLHPATGIDDLMQQIAEHIDSDCLFALSHHELETRFGLPGGGYDNIQRLLFPDIRPEDPDYHQKIILAIEDLRYGKRTISRQAQDALMEQERRLREATLLLIQGSQETRGQGEEPKRTRYFEVSATPAYSSRHNNGLGGNFQYIGQLPGYLKIHGEMLENQSLFRLSNRERNPDKPFLDIHFDENGKITRIVVYEKNIYFNPNLGRR

SEQ ID NO: 1674 - protein, 144 aa, Neisseria
VPLPAPCRFAKPAASFLSMALLSCQLSHAATAYIPPNDFQPNCDIRRLGLTQGQHNELRKIRAAFKMAGDRARLKVMHSEHSRRRSVVEIISSDVFNRNEARDYVESRYHSSMDFAVDELEIQHRFFHILTPQQQQMWLSSCLK

SEQ ID NO: 1675 - protein, 144 aa, Neisseria
VPLPAPCRFAKPAASFLSMALLSCQLSHAATAYIPPNDFQPNCDIRRLGLTQSQHNELRKIRTAFKMAGDRARLKVMHSEHSRRRSVVEIISSDVFNRNEARDYVESRYLSGMDFAVDELEIQHRFFHILTPQQQQMWLSSCLK

SEQ ID NO: 1676 - protein, 144 aa, Neisseria
  VARIANT (1)...(144): Xaa = Any Amino Acid
VPLXAPCRFAKPAASFLSMALLSCQLSHAATAYIPLNDFQPNCDIRRLGLTQGQHNELRKIRAAFKMAGDRARLKVMHSEHSRRRSVVEIISSDVFNRNEARDYVESRYLSGMDFAVDELEIQHRFFHILTPQQQQMWLSSCLK

SEQ ID NO: 1677 - protein, 337 aa, Neisseria
VSHTRCRCSESIRRIWRNGREWRIKGQKCRLNTDAVQTASFYTTALFGCAFIPCGRVFVALEAFVRVGFERVGVIGLGYVFKPLAVFVGGFDGRPVDIGKARLLEQGFGQLHAAAYGVVAVDDGKIHVGAAARQLCGFKLDDFDVFQVFRDVGFGCGQRIDAVFEFDPTQFVQHHQGACEVGRVVGRGYGAAVFDFFQRFQFARIQSQRRGRHLEGFGDVQVVFFFEIVKIGFVLEDVDVQLALRQCQIRAHIVGKFDQFDGVAFFLQLGLDLFFDHIAEVAHGRAEDDFFFRRAVIGRRGGGRGCGRAVFLTAAGCEDERECGGGKGFEEGFHIFS

SEQ ID NO: 1678 - protein, 336 aa, Neisseria
VLHTLCRCSESIRRIRRNGREWRIKGQKCRLNTDTVQTASFYTTALFGCAFIPCGRGFVALEAFVRVGFERVGVIGLGYVFKPLAVFVGGFDGRPVDIGKARFLEQGFGQLHAAAYGVVAVDDGKIHVGAATRQLRGFKLDDFDVFQVLGDVRFGCGQRIDAVFEFDPTQFVEHHQDAGEVGRVVGRGYGAAVFDFFQRFQLARVQSQRRGRHLEDFGDVQIVFFFEVVKIGFVLEDVDVQLALSQCQIRAYIVGKLDQFDGVAFFLQLGLDLFFDHIAEVADGRAEDDFFFRRAVVGGGRSGCGGRAVFLTAAGGEDERECGGGKGFEEGFHIFS

SEQ ID NO: 1679 - protein, 336 aa, Neisseria
VLHTLCRCSESIRRIRRNGREWRIKGQKCRLNTDTVQTASFYTTALFGCAFIPCGRGFVALEAFVRVGFERVGVIGLGYVFKPLAVFVGGFDGRPVDIGKARFLEQGFGQLHAAAYGVVAVDDGKIHVGAATRQLRGFKLDDFDVFQVFGNVRFGCGQRIDAVFEFDPTQFVEHHQDAGEVGRVVGRGYGAAVFDFFQRFQLARVQSQRRGRHLEDFGDVQIVFFFEVVKIGFVLEDVDVQLALSQCQIRAHIVGKLDQFDGVAFFLQLGLDLFFDHIAEVADGRAEDDFFFRRAVVGGGRSGCGGRAIFLTAAGGEDERECGGGKGFEEGFHIFS

SEQ ID NO: 1680 - protein, 372 aa, Neisseria
  VARIANT (1)...(372): Xaa = Any Amino Acid
SAFVLPKHPMPALTPASTFAQIGFGFALAAQLLGQDEHDAFFRAPPFAHGFMPPSAYGCQYFPHQHFGRGRACRYADFAFAFKPRALQVGRVVHHIRIDSARCRHFAQAVAVGRIGRTDHNHDVALFRQLFDGGLPVGRRIADVFLVRIADIGETRVQRGDDVFGFIDRERGLADIGEFVGVSDFEFCHISDRFDQKHFARCKLPHRAFDLGVPLMPDHDDFTVLGIQSGDFLMHFRHQRASRIKYPETALRRFLLHRLRYAVCRINQCRARRHFRQVFDKHRAFFAQVVHDEFVVDDFVAHINRRAEFFQSTFDNTDCPIHTGAEAARIGKDDGFSVHKFCIPCSDGIHVFLLXLCDGRYCQAPPTPHRRR

SEQ ID NO: 1681 - protein, 385 aa, Neisseria
LVSASGTRQKCRLKPVQTAFVLPKHSTPASTFAQIGFGFALAAQLFGQDEHNAFFRTLAFAYGFVPPSAYGCQYFPHQHFGRGRACRYADFVFALKPCALQVACIIHHIRIDSARCRHFAQAVAVGRIGRTDHNHDVALFCQLFDGGLPVGRRIADIFLVRIADIGETRVQRGDDVFGFIDRERGLADIGEFVGVSDFEFCHISDRFDQKHFARRKLPHRSFDLDVPLMPDHDDFTVLGIQSGDFLMHFRHQRASRIKHAETALRRFLPHRLRYAVCRINQCRARRHFRQVFNKHRTFFTQVVHDEFVVNDFVAHINRRAELFQSTFDNTDCPIHTSAEAARIGKDDGFLVHKPGISFSDGINIFLLGFYGGRCCPTPPTPHRRR

SEQ ID NO: 1682 - protein, 385 aa, Neisseria; identical to SEQ ID NO: 1681

SEQ ID NO: 1683 - protein, 304 aa, Neisseria
LPQTRPARRHHRHRQYFVERKGDARSGFCAAQCQNSQRFQSKPAERYADCPHHPARRRRFDPASEKIMKTKLPLFIIWLSVSASCASVLPVPEGSRTEMPTQENASDGIPYPVPTLQDRLDYLEGKIVRLSNEVEMLNGKVKALEHTKIHPSGRTYVQKLDDRKLKEHYLNTEGGSASAHTVETAQNLYNQALKHYQNGRFSAAAALLKGADGGDGGSIAQRSMYLLLQSRARMGNCESVIEIGGRYANRFKDSPTAPEVIFKIGECQYRLQQKDIARATWRSLIQTYPGSPAAKRAAAAVRKR

SEQ ID NO: 1684 - protein, 305 aa, Neisseria
LPQTRPSRRHHRHRQYFAERKGDARSGFRCAAQRRHPQRFQSKPAERPAHRPHHPARRRRLDPASEKIMKIKLPLFIIWLSVSASCASVSPVPAGSQTEMSTRENASDGIPYPVPTLQDRLDYLEGKIVRLSNEVETLNGKVKALEHAKTHSSGRAYVQKLDDRKLKEHYLNTEGGSASAHTVETAQNLYNQALKHYKSGKFSAAASLLKGADGGDGGSIAQRSMYLLLQSRARMGNCESVIEIGGRYANRFKDSPTAPEAMFKIGECQYRLQQKDIARATWRSLIQTYPGSPAAKRAAAAVRKR

SEQ ID NO: 1685 - protein, 305 aa, Neisseria
LPQACPARRHHCHRQYFVERKGDARSGFRCAAQRRHPQRFSKPAERYADCPHHPARRRRFDPASEKIMKTKLPLFIIWLSVSAACSSPVSRNIQDMRLEPQAEAGSSDAIPYPVPTLQDRLDYLEGTLVRLSNEVETLNGKVKALEHAKTHPSSRAYVQKLDDRKLKEHYLNTEGGSASAHTVETAQNLYNQALKHYKSGRFSAAASLLKGADGGDGGSIAQRSMYLLLQSRARMGNCESVIEIGGRYANRFKDSPTAPEAMFKIGECQYRLQQKDIARATWRSLIQTYPGSPAAKRAAAAVRKR

SEQ ID NO: 1686 - protein, 120 aa, Neisseria
LGCRQAASHHFCQGNKLFGGIFHFVCRFLSRVGSFVQSIFSCFSYSFFGFSYSFLGTCLCISRSIFDLVFRFFDGRSGRLGGRSRSVFNIGLNGLNRFLNLLFGFLRTSCQGSRHHCGNQ

SEQ ID NO: 1687 - protein, 120 aa, Neisseria; identical to SEQ ID NO: 1686

SEQ ID NO: 1688 - protein, 300 aa, Neisseria
MSSLMTLFSVLVPMFAGFFIRVPKPYLPASDKVLSVLVYAVLLLIGVSLSRVEDLGSRLGDMALTVLWLFVCTVGANLLALAVLGKLSPWRIGGKGKGVSVGVSGSVRQLGCVLLGFVSGKLMCDIWMPSENAGMYCLMLLVFLIGVQLKSSGVSLRQVLLNRRGIRLSVWFILSSLSGGLLFAASADGVSWTKGLAMASGFGWYSLSGLVMTEAYGAVWGSIMLLNDLARELFALAFIPLLMKRFPDAAVGVGGATSMDFTLPVIQGAGGLEVVPVAVSFGVVVNIAAPFLMVVFSTLG

SEQ ID NO: 1689 - protein, 300 aa, Neisseria
MDSLMTLLSVLIPMFAGFFIRVPKPYLPALDKVLSVLVYAVLLLIGVSLSRVEDLGSRLDDMALTVLWLFVCTVGANLLALAVLGKLFPWRIKGKGKGVSVGVSGSVGQLGCVLLGFAFGKLMRDIWMPSESAGMYCLMLLVFLIGVQLKSSGVSLRQVLVNRRGIRLSVWFMLSSLSGGLLFAASTDGVSWTKGLAMASGFGWYSLSGLVMTEAYGAVWGSIMLLNDLARELFALAFIPLLMKRFPDAAVGVGGATSMDFTLPVIQGAGGLEVVPVAVSFGVVVNIAAPFLMVVFSALG

SEQ ID NO: 1690 - protein, 300 aa, Neisseria
  VARIANT (1)...(300): Xaa = Any Amino Acid
MDSLMTLLSVLIPMFAGFFIRVPKPYLPALDKVLSVLVYAVLLLIGVSLSRVEDLGSRLDDMALTVLWLFVCTVGANLLALAVLGKLFPWRIKGKGKGVSVGVSGSVGQLGCVLLGFASGKLMRDIWMPSENAGMYCLMLLVLXIGVQLKSSGVSLRQVLVNRRGIRLSVWFMLSSLSGGLLFAASADGVSWVKGLAMASGFGWYSLSGLVMTEAYGAVWGSIALLNDLARELFALAFIPLLMKRFPDAAVGVGGATSMDFTLPVIRGAGGLEAVPVAVSFGVVVNIAAPFLMVVFSALG

SEQ ID NO: 1691 - protein, 128 aa, Neisseria
MSWHIFQVAGIPTASMAQSTPSSPTMAKTCLETSPEAGLMVWVAPNSFAGFKRFSSISHTIMAAGLYSWAVNKADIPTGPAPAMNTVSPGFTSPYCTPISWAVGKASLNSRAISSLTLSCGGTRLLSA

SEQ ID NO: 1692 - protein, 128 aa, Neisseria
MSWHIFHVAGIPTASMAQSTPSSPTMAKTCLDTSPEAGLMVWVAPNSFASFKRFSSISQTMMAAGLYSWAVNRADIPTGPAPAMNTVSPGLTSPYCTPISWAVGKASLNNRAISSLTLSGSGTRLLSA

SEQ ID NO: 1693 - protein, 128 aa, Neisseria
MSWHIFQVAGIPTASIAQSTPSSPTIAATCLLTSPEAGLMVWVAPNSFASFKRFSSISQTMMAAGLYSWAVGKADIPTGAAPAMNTVSPGLTSPYCTPISCAVGKASLNNRATSSLTLSGSGTRLLSA

SEQ ID NO: 1694 - protein, 124 aa, Neisseria
MPCSKASWTSPGVATPGIRGMPLLRPALARDSCKPGLMAKTAPASSTALSCSGLVTVPAPMMALGISLAIRRMASSPTGVRKVISRVGMPPSTRARDKSTAVLKSSIAITGTTAPAVRISRGVS

SEQ ID NO: 1695 - protein, 143 aa, Neisseria
MPCSKASWISPGVATPGIRGMPLLWPALARDSCSPGLMAKTAPASSTALSCSGLVTVPAPTMALGTSLAIRRMASRPTGVRRVISRVGMPPSTRAWDKSMAVLKSSIAITGTTAPAVKISRGVSLDISVLRVEWGILLRWDRL

SEQ ID NO: 1696 - protein, 143 aa, Neisseria; identical to SEQ ID NO: 1695

SEQ ID NO: 1697 - protein, 288 aa, Neisseria
MKAKILTSVALLACSGSLFAQTLATVNGQKIDSSVIDAQVAAFRAENSRAEDTPQLRQSLLENEVVNTVVAQEVKRLKLDRSAEFKDALAKLRAEAKKSGDDKKPSFKTVWQAVKYGLNGEAYALHIAKTQPVSEQEVKAVYDNISGFYKGTQEVQLGEILTDKEENAKKAVADLKAKKGFDAVLKQYSLNDRTKRTGAPDGYVPLKDLEQGVPPLYQAIKDLKKGEFTATPLKNGDFYGVYYVNDSREVKVPSFDEMKGQIAGNLQAERIDRAVCALLGKANIKPAK

SEQ ID NO: 1698 - protein, 288 aa, Neisseria
MKAKILTSVALLACSGSLFAQTLATVNGQKIDSSVIDAQVAAFRAENSRAEDTPQLRQSLLENEVVNTVVAQEVKRLKLDRSAEFKNALAKLRAEAKKSGDDKKPSFKTVWQAVKYGLNGEAYALHIAKTQPVSEQEVKAAYDNISGFYKGTQEVQLGEILTDKEENAKKAVADLKAKKGFDAVLKQYSLNDRTKQTGAPVGYVPLKDLEQGVPPLYQAIKDLKKGEFTATPLKNGDFYGVYYVNDSREVKVPSFDEMKGQIAGNLQAERIDRAVGALLGKANIKPAK

SEQ ID NO: 1699 - protein, 288 aa, Neisseria; identical to SEQ ID NO: 1698

SEQ ID NO: 1700 - protein, 823 aa, Neisseria
MKKTCFHCGLDVPENLHLTVRYENEDRETCCAGCQAVAQSIIDAGLGSYYKQRTADAQKTELPPQEILDQIRLYDLPEVQSDFVETHGGTREAVLMLGGITCAACVWLIEQQLLRTDGIVRIDLNYSTHRCRVVWDDGKIRLSDILLKIRQIGYTAAPYDAQKIEAANQKERKQYIVRLAVAGLGMMQTMMFALPTYLYGGDIEPDFLQILHWGGFLMVLPVVFYCAVPFYQGALRDLKNRRVGMDTPITVAIIMTFIAGVYSLATNAGQGMYFESIAMLLFFLLGGRFMEHIARRKAGDAAERLVKLIPAFCHHMPDYPDTQETCEAAVVKLKAGDIVLVKPGETIPVDGTVLEGSSAVNESMLTGESLPVAKMPSEKVTAGTLNTQSPLIIRTDRTGGGTRLSHIVRLLDRALAQKPRTAELAEQYASSFIFGELLLAVPVFIGWTLYADAHTALWITVALLVITCPCALSLATPTALAASTGTLAREGILIGGKQAIETLAQTTDIIFDKTGTLTQGKPAVRRISLLRGTDEAFVLAVAQALEQQSEHPLARAILNCRISDGSVPDIAIKQRLNRIGEGVGAQLTVNGETQVWALGRASYVAEISGKEPQTEGGGSAVYLGSQSGFQAVFYLQDPLKDSAAEAVRQLAGKNLTLHILSGDRETAVAETARALGVAHYRAQAMPEDKLEYVKALQKEGKKVLMIGDGINDAPVLAQADVSAAAAGGTDIARDGADIVLLNEDLRTVAHLLDQARRTRHIIRQNLIWAGAYNIIAVPLAVLGYVQPWIAALGMSFSSLAVLGNALRLHKRGKMQSEKMPSEQ

SEQ ID NO: 1701 - protein, 238 aa, Neisseria
VFNNFLASLPFMTETRADMLISAFWPMVKAGFTVSLPLAIASFVIGMIIAVAVALVRIMPSGGIFQKCLLKLVEFYISVVRGTPLLVQLVIVFYGLPSVGIYINPIPAAIIGFSLNVGAYASETIRAAILSVPKGQWEAGFSIGMTYMQTFRRIVAPQAFRVAVPPLSNEFIGLFKNTSLAAVVTVTELFRVAQETANRTYDFLPVYIEAALVYWCFCKVLFLIQARLEKRFDRYVAK

SEQ ID NO: 1702 - protein, 238 aa, Neisseria
VFNNFLASLPFMTETRADMIVSAFLPMVKAGFAVSLPLAAASFVIGMMIAVAVALVRIMPAGGIVRKILLKLVEFYISVIRGTPLLVQLVIVFYGLPSVGIYIDPIPAAIIGFSLNVGAYASETIRAAILSVPKGQWEAGFSIGMTYMQTFRRIVAPQAFRVAVPPLSNEFIGLFKNTSLAAVVTVTELFRVAQETANRTYDFLPVYIEAALVYWCFCKVLFLIQARLEKRFDRYVAK

SEQ ID NO: 1703 - protein, 238 aa, Neisseria; identical to SEQ ID NO: 1702

SEQ ID NO: 1704 - protein, 375 aa, Neisseria; identical to SEQ ID NO: 350

SEQ ID NO: 1705 - protein, 375 aa, Neisseria; identical to SEQ ID NO: 347

SEQ ID NO: 1706 - protein, 375 aa, Neisseria; identical to SEQ ID NO: 348

SEQ ID NO: 1707 - protein, 559 aa, Neisseria
MEIINDAELIRSMQRQQHIDAELLTDANVRFEQPLEKNNYVLSEDETPCTRVNYISLDDKTVRKFSFLPSVLMKETAFKTGMCLGSNNLSRLQKAAQQILIVRGYLTSQAIIQPQNMDSGILKLRVSAGEIGDIRYEEKRDGKSAEGSISAFNNKFPLYRNKILNLRDVEQGLENLRRLPSVKTDIQIIPSEEEGKSDLQIKWQQNKPIRFSIGIDDAGGKTTGKYQGNVALSFDNPLGLSDLFYVSYGRGLAHKTDLTDATGTETESGSRSYSVHYSVPVKKWLFSFNHNGHRYHEATEGYSVNYDYNGKQYQSSLAAERMLWRNRLHKTSVGMKLWTRQTYKYIDDAEIEVQRRRSAGWEAELRHRAYLNRWQLDGKLSYKRGTGMRQSMPAPEENGGDILPGTSRMKIITASLDAAAPFILGKQQFFYATAIQAQWNKTPLVAQDKLSIGSRYTVRGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 1708 - protein, 487 aa, Neisseria
  VARIANT (1)...(487): Xaa = Any Amino Acid
XKETAFKTGMCLGSNNLSRLQKAAQQILIVRGYLTSQAIIQPQNMDSGILKLRVSAGEIGDIRYEEKRDXKSAEGSISAFNNKXPLYRNKILNLRDVEQGLENLRRLPSVKTDIQIIPSEEEGKSDLQIKWQQNKPIRFSIGIDDAGGKTTGKYQGNVALSXDNPLGLSDXFYVSYGRGLVHKTDLTXATGTETESGSRSYSVHYSVXVKKWLFSFNHNGHRYHEATEGYSVNYDYNGKQYQSSLAAERMLWXXXFXXTSVXMKLWTRQTYKYIDDAEIEVQRRRSAGWEAELRHRAYLXRWQLDGKLSYKRGTGMRQSMPAPEENGGGTIPXXSRMKIITAGLDAAAPXMLGKQQFFYATAIQAQWNKTPLVAQDKLSIGSRYTVRGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 1709 - protein, 253 aa, Neisseria
MPFKPSKRISLLLVLALGACSTSYRPSRAEKANQVSNIKTQLAMEYMRGQDYRQATASIEDALKSNPKNELAWLVRAEIYQYLKVNDKAQESFRQALSIKPDSAEINNNYGWFLCGRLNRPAESMAYFDKALADPTYPTPYIANLNKGICSAKQGQFGLAEAYLKRSLAAQPQFPPAFKELARTKMLAGQLGDADYYFKKYQSRVEVLQADDLLLGWKIAKALGNVQAAYEYEAQLQANFPYSEELQTVLTGQ

SEQ ID NO: 1710 - protein, 253 aa, Neisseria
MPFKPSKRISLLLVLALGACSTSYRPSRAEKANQVSNIKTQLAMEYMRGQDYRQATASIEDALKSDPKNELAWLVRAEIYQYLKVNDKAQESFRQALSIKPDSAEINNNYGWFLCGRLNRPAESMAYFDKALADPTYPTPYIANLNKGICSAKQGQFGLAEAYLKRSLAAQPQFPPAFKELARTKMLAGQLGDADYYFKKYQSRVEVLQADDLLLGWKIAKALGNAQAAYEYEAQLQANFPYSEELQTVLTGQ

SEQ ID NO: 1711 - protein, 253 aa, Neisseria
  VARIANT (1)...(253): Xaa = Any Amino Acid
MPFKPSKRISLLLVLALGACSTSYRPSRAEKANQVSNIKTQLAMEYMRGQDYRQXTASIEDALKSDPKNELAWLVRAEIYQYLKVNDKAQESFRQXLSIKPDSAEINNNYXWFLCGRLNRPAESMAYFDKALADPTYPXPYIANLNKGICSAKQGQFGLAEAYLKRSLAAQPQFPPAFKELARTKMLAGQLGDADYYFKKYQSRVEVLQADDLLLGWKIAKALGNAQAAYEYEAQLQANFPYSEELQTVLIGQ

SEQ ID NO: 1712 - protein, 459 aa, Neisseria
MFAFKSLLDMPRGEALAVVVALIAAMGYTIISLEWLPHMSIIAAIVVLILYGLARGLKYNDMQAGMIGALNQGMGAVYLFFFIGLMVSALMMSGAIPTLMYYGFGLISPTYFYFSAFALCSVIGVSIGSSLTACATVGVAFMGMAAAFQADMAMTAGAIVSGVFFGDKMSPLSDTTGISASIVGIDLFEHIKNMMYTTIPAWLISAALMLWLLPSVAAQDLNSVESFRSQLEATGLVHGYSLIPFALLVVLALMRVNAVVAMLFTVIAAVAVTYLHSTPDLRQLGAWFYGGYKLEGEAFKDIAKLISRGGLESMFFTQTIVILGMSLGGLLFALGVIPSLLEAVRTFLTNAGRATFSVAMTSVGVNFLIGEQYLSILLSGETFKPVYDKLGLHSCNLSRTLEDAGTVINPLVPWSVCGVFISHALGVPVWEYLPYAFFCYLSLALTLLFGWTGLTLSKK

SEQ ID NO: 1713 - protein, 459 aa, Neisseria
MFAFKSLLDMPRGEALAVVVALIAAMGYTIISLEWLPHMSIIAAIVVLILYGLARGLKYNDMQQGMIGALNQGMGAIYLFFFIGLMVSALMMSGAIPTLMYYGFGLISPTYFYFSSFALCSVIGVSIGSSLTTCATVGVAFMGMAAAFQADMAMTAGAIVSGAFFGDKMSPLSDTTGISASIVGIDLFEHIKNMMYTTIPAWLISAALMLWLLPNVAAQDLNSVESFRSQLEATGLVHGYSLIPFALLVILALMRINAVVAMLFTVMVAVAVTYLHSTPDLRQLGAWFYGGYKLEGEAFKDVVKLISRGGLESMFFTQTIVILGMSLGGLLFALGVIPSLLEAIRTFLTNAGRATFSVAMTSVGVNFLIGEQYLSILLSGETFKPVYDKLGLHSRNLSRTLEDAGTVINPLVPWSVCGVFISHALGVPVWEYLPYAFFCYLSLALTLLFGWTGLTLSKK

SEQ ID NO: 1714 - protein, 459 aa, Neisseria
  VARIANT (1)...(459): Xaa = Any Amino Acid
MFAFXSLLDMPRGEALAVVVALIAAMGYTIIXLEWLPHMSIIAAIVVLILYGLARGLKYNDMQQGMIGALNQGMGAIYLFFFIGLMVSALMMSGAIPTLMYYGFGLISPTYFYFSAFALCSVIGVSIGSSLTTCATVGVAXMGXXXAFXAXMXXXXXXIVXXAXXGXKMSPLSDTXGXSASIVGIDLFEHIKNMMYTTIPAWLISXXLMLXLLPSVAAQDLNSVESFRSQLEATGLVHCYSLIPFALLVVLALMRVNAVVAMLFTVIAAVAVTYLHSTPDLRQLGAWFYGGYKLEGEAXXDIAKLISRGGLESMFFTQTIVILGMSLGGLLFALGAIPSLLDAVRSFLTNAGRXTFSVAMTSVGVNFLIGEQYLSILLSGETFKPVYDKLGLHSRNLSRTLEDAGTVINPLVPWSVCGVFIXHALGVPVWEYLPYAFFCYLSLALTLLFGWTGLTLSKK

SEQ ID NO: 1715 - protein, 125 aa, Neisseria
METHEKIRLMRELNKWSQEDMAEKLAMSAGGYAKIERGETQLNIPRLEQLAQIFKIDMWDLLKSGGGGMVFQINEGDSGGDIALYASGDVSMKIEFLKMELKHCKEMLEQKDKEIELLRKLTETV

SEQ ID NO: 1716 - protein, 126 aa, Neisseria
METHEKIRLMRELNKWSQEDMAEKLAMSAGGYAKIERGETQLNIPRLEQLAQIFKIDMWDLLKSGGGGMVLQINDVDTNSGEFAIYTAQDASGKAGFVKMELKHCKEMLEHKDKEIELLRKLTETV

SEQ ID NO: 1717 - protein, 431 aa, Neisseria
MPAPDLGFALSLPPKKAIEWLESKKVTAESYRNLTASEIAKVYTIARMTDLDMLNDIKTSMVESAKSGQSFDDWRKGILNLLSNKGWLHPNGHNGKDIIDPATGEVFGSPRRLETIYRTNMQTAYNAGQYQGYMANIDARPYWMYDAVGDSRTRPAHSAIDGLVYRYDDPFWATFYPPNGYNCRCSVIALSERDVERQGRIVGQSTADNLVETHKIYNKKGDTYLTLAYKAPDGSLYTTDRGFDYNAGRMNYRPDLDKYDRALAHQFAKAEMGGADFKTSFKQLEKEFYEVKQRLDIDGKPDKEQKIKIRNALSRQLKFAAGVLSKETQELAGMTRATVWLSDDTLVKQVDSREGQNFDDSYYAFLPDMLQNPEHVIRDNRELIFTARYKGSALWAVLKYIKEVDEIYLQSYRISNDKEIAKFMAKKKVLK

SEQ ID NO: 1718 - protein, 431 aa, Neisseria
MPAPDLGFALSLPPKKAIEWLESKKVTAESYRNLTASEIAKVYTIARMTDLDMLNDIKTSMVESAKSGQSFDDWRKGILNLLSNKGWLHPNGHNGKDIIDPATGEVFGSPRRLETIYRTNMQTAYNAGQYQGYMANIDARPYWMYDAVGDSRTRPAHSAIDGLVYRYDDPFWATFYPPNGYNCRCSVIALSERDVERQGRIVGQSTSDNLVETHKIYNKKGDTYLTLAYKAPDGSLYTTDRGFDYNAGRMNYRPDLDKYDRALAHQFAKAEMGGADFKTSFKQLEKEFYEVKQRLDIDGKPDKEQKIKIRNALSRQLKFAAGVLSKETQELAGMTRATVWLSDDTLVKQVDSREGQNFDDSYYAFLPDMLQNPEHVIRDNRELIFTARYKGSALWAVLKYIKEVDEIYLQSYRISNDKEIAKFMAKKKVLK

SEQ ID NO: 1719 - protein, 470 aa, Neisseria
MMPHIDFDTIPGSIRVPGQYIEFNTRNAVQGLPQNPQKVLMVAPMLTAGIQPALEPVQLFSDAEAADLFGQGSLAHLMVRQAFANNPYLDLTVIGIADHSAGVQATATVTLSGTATAPGVVEITIGGKQVSTAVNTGETAATVADRLKTAITAADVTVTASGSGAAVTLTAKHKGEIGNESGLTVSTGNTGLTYQANAFTGGAKNADIATALSKVAGKHYHIICSPFSDDANAKALSNHITNVSNAIEQRGCIGVLGMSAALSTATTATGEINDGRMTCAWYKGAVEPNGIIAAGYAAVLAFEEDPAKPLNTLEIKGLAVTPDAQWPLFAECNNALYNGLTPLTVVNNRVQIMRAVSTYTKSANNTDDPALLDITTIRTLDYVRRSVKERIALRFPRDKLSDRLLPKVKSEILDVLIKLDQAEIIENAEANKGKLVVARAQNDPNRVNAIIPADVVNGLHVFAGRIDLIL

SEQ ID NO: 1720 - protein, 381 aa, Neisseria
MQNNSYGYAVSVRVGGKEHRHWERYDIDSDFLIPADSFDFVIGRLGPEAAIPDLSGESCEVVIDGQIVMTGIIGSQRHGKSKGSRELSLSGRDLAGFLVDCSAPQLNVKGMTVLDAAKKLAAPWPQIKAVVLKAENNPALGKIDIEPGETVWQALTHIANSVGLHPWLEPDGTLVVGGADYSSPPVATLCWSRTDSRCNIERMDIEWDTDNRFSEVTFLAQSHGRSGDSAKHDLKWVYKDPTMTLHRPKTVVVSDADNLAALQKQAKKQLADWRLEGFTLTITVGGHKTRDGVLWQPGLRVHVIDDEHGIDAVFFLMGRRFMLSRMDGTQTELRLKEDGIWTPDAYPKKAEAARKRKGKRKGVSHKGKKGGKKQAETAVFE

SEQ ID NO: 1721 - protein, 381 aa, Neisseria
MQNNSYGYAVSVRVGGKEHRHWERYDIDSDFLIPADSFDFVIGRLGPEAAIPDLSGESCEVVIDGQIVMTGIIGSQRHGKSKGGRELSLSGRDLAGFLVDCSAPQLNVKGMTVLDAAKKLAAPWPQIKAVVLKVENNPALDKIDIEPGETVWQALTHIANSVGLHPWLEPDGTLVVGGVDYSSPPVATLCWSRTDSRRNIERMDIEWDTDNRFSEVTFLAQSHGRSGDSAKHDLKWVYKDPTMTLHRPKTVVVSDADNLAALQKQAKKQLADWRLEGFTLTITVGGHKTRDGVLWQPGQRVHVIDDEHGIDAVFFLMGRRFMLSRMDGTQTELRLKEDGIWTPDAYPKKAEAARKRKGKRKGVSHKGKKGGKKQAETAVFE

SEQ ID NO: 1722 - protein, 186 aa, Neisseria
MSYQDILRGLLPPVSYARNAPRVRAQAEIDGAALDAVAESAQSVADAVDPRSAGQMLADWERVLGLDGTGKNRQHRVLAVMAKLNETGGLSIPYFVRLAEAAGYQIQIDEPQPFRAGVNRAGDRLAPQEIMWVWHVNVRGGNNRITRFRAGISAAGDRLTDYSDAVIESLFNRLKPAHTAIRFTYR

SEQ ID NO: 1723 - protein, 186 aa, Neisseria
MSYQDILRGLLPPVSYARNAPRVRAQAEIDGAALDAVAESAQSVADAVDPSSAGQMLADWERVLGLDGTGKNRQRRVLAVMAKLNETGGLSIPYFVRLAEAAGYQIQIDEPQPFRAGVNRAGDRLAPQEIMWVWHVNVRGGNNRITRFRAGISAAGDRLTDYSDAVIESLFNRLKPAHTAIRFTYR

SEQ ID NO: 1724 - protein, 138 aa, Neisseria
MIDVKIDNIFVVLNQIERLGNGIENRYLLMRRLSETMHTAVKLNFRYAGRPKWVGLKYRDGKPLSDSGRLKDSFSTLSDNDTALVGTNIVYAAIHNFGGMAGRNRKVRIPQREFLTLTDDDKQALMDDVQDYFSGLIP

SEQ ID NO: 1725 - protein, 138 aa, Neisseria
MIDVKIDNIFVVLNQIERLGNGIENRYLLMRRLSETMHTAVKLNFRYAGRPKWLGLKYRDGKPLSDSGRLKDSFSTLSDNDTALVGTNIVYAAIHNFGGMAGRNRKVRIPQREFLTLTDDDKQALMDDVQDYFSGLIP

SEQ ID NO: 1726 - protein, 112 aa, Neisseria
MNKNIAAALAGALSLSLAAGAVAAHKPASNATGVQKSAQGSCGASKSAEGSCGASKSAEGSCGAAASKAGEGKCGEGKCGATVKKAHKHTKASKAKAKSAEGKCGEGKCGSK

SEQ ID NO: 1727 - protein, 102 aa, Neisseria
MNKNIAAALAGALSLSLAAGAVAANKPASNATGVHKSAHGSCGASKSAEGSCGAAGSKAGEGKCGEGKCGATVKKTHKHTKASKAKAKSAEGKCGEGKCGSK

SEQ ID NO: 1728 - protein, 102 aa, Neisseria; identical to SEQ ID NO: 1727

SEQ ID NO: 1729 - protein, 473 aa, Neisseria; identical to SEQ ID NO: 221

SEQ ID NO: 1730 - protein, 473 aa, Neisseria; identical to SEQ ID NO: 219

SEQ ID NO: 1731 - protein, 473 aa, Neisseria; identical to SEQ ID NO: 220

SEQ ID NO: 1732 - protein, 380 aa, Neisseria
SDGLYVPRNFIHRPQSWFKWDKDNGLLLRTRENPEGEALWPLGWVVHTQKSRSVQQARNGLFRTLSWLYMFKHYAVHDFAEFLELYGMPIRIGKYGAGATKEEKNTLLRAVAEIGHNAAGIMPEGMEIELHNAANGTTATSNPFLQMADWCEKSAARLILGQTLTSGADGKSSTNALGNIHNEVRRDLLVSDAKQVAQTITSQIIGPFLQINYPHADPNRVPKFEFDTREPKDIAVFADAIPKLVDVGVQIPESWVRDKLVIPDVQEGEAVLVRQVPDNPVNRTALAALSAHTVPSKATGRHQEILDGALDDALVEPDFNSQLNPMVRQAVAALNACNSYEEADAALNALYPNLDNAKLRTYMQQALFISDILGQDHARA

SEQ ID NO: 1733 - protein, 526 aa, Neisseria
MEPIMAKKNNKTKIQKPEAALQTDVAQITATGRVIAEHPSNFITPQKMRALFEDAESGDIRAQHELFADIEERDSDIAANMGTRKRALLTLNWRVAPPRNATPEEEKLSDQAYEMMDSLPTLEDLIMDLMDAVGHGFSALEVEWVFSDGLYLPRNFIHRPQSWFKWDKDNGLLLRTRENPEGEALWPLGWVVHTQKSRSVQQARNGLFRTLSWLYMFKHYAVHDFAEFLELYGMPIRIGKYGAGATKEEKNTLLRAVAEIGHNAAGIMPEGMEIELHNAANGMTSAGNPFLQMADWCEKSAARLILGQTLTSGADGKSSTNALGNIHNEIRRDLLVSDAKQVAQTITSQIIGPFLQINYPHADPNRVPKFEFDTREPKDIAVFADAIPKLVDVGVQIPESWVRDKLVIPDVQEGEAVLVRQVPDNPVNRTALAALSAHTVPSKATGRHQEILDGALDDALVEPDFNSQLNPMVRQAVAALNACNSYEEADAALNALYPNLDNAKLRTYMQQALFISDILGQDHARA

SEQ ID NO: 1734 - protein, 526 aa, Neisseria
MEPIMAKKNNKTKIQKPEAALQTDVAQITATGRVIAEHPSNFITPQKMRALFEDAESGDIRAQHELFADIEERDSDIAANMGTRKRALLTLNWRVAPPRNATPEEEKLSDQAYEMMDSLPTLEDLIMDLMDAVGHGFSALEVEWVFSDGLYLPRNFIHRPQSWFKWDKDNGLLLRTRENPEGEALWPLGWVVHTQKSRSVQQARNGLFRTLSWLYMFKHYAVHDFAEFLELYGMPIRIGKYGAGATKEEKNTLLRAVAEIGHNAAGIMPEGMEIELHNAANGTTATSNPFLQMADWCEKSAARLILGQTLTSGADGKSSTNALGNIHNEVRRDLLVSDAKQVAQTITSQIIGPFLQINYPHADPNRVPKFEFDTREPKDIAVFADAIPKLVDVGVQIPESWVRDKLVIPDVQEGEAVLVRQVPDNPVNRTALAALSAHTVPSKATGRHQEILDGALDDALVEPDFNSQLNPMVRQAVAALNACNSYEEADAALNALYPNLDNAKLRTYMQQALFISDILGQDHARA

SEQ ID NO: 1735 - protein, 526 aa, Neisseria; identical to SEQ ID NO: 1733

SEQ ID NO: 1736 - protein, 723 aa, Neisseria
MANGNMKLSLVLTARDDGARRLLADTQRQLDRTAKSRAQLERQSHTYALTGIRSEKQIQREIMLTQAAFNRLARSGKASQNDLARAAVATRNRIRELNAELKQGTGFADKMGKIGRFGAAAVAGGAAAYTVLKPAMDNRKQLDENINRVSRQAFIEDNSKSAAWIATEGAQQIKDLALELVEKNGGTHDKALDLISGMMTTGLNFAQTKNEAQAAYAFALASEGSGEDTAKLIKTLKDGGMSGKDLQLGLEHVLQSGLDGTFEVRDMVRELPSLLSAAQQAGMNGVGGLDYLLSLLQSAANKSGSPAEAATNVQNLLSKTLSPDTIGRLKKMANPNDPKKGVDWIGSVVQGKQNGENAVQVLSRLADAMLVKDKQYQDYKKRAAAGDKTAAEQANMLKGALLAQLLPDLQAKQGLLAATDMTQIREYMASLAGVTLDNGKIAKNNEARMLSAAAQQEQQESLAMLRESLTGTLVDMETSFKKLAAEYPNATLALQALTTAATAASAAMLLTAGGGKGAGFLKDVGSKALGWGKASAGGVAAGATAAGGKLLSWGKSAGSGLMNNPALVKRAGLLGMLLYSESLGDGTLPKGLRGTKTTPEMINRLKNNGIRFEPAPKREQARGGVPQYLAAPSAQPTDKMLSPLFSTQTAAYQAAIQQQTAAYQAALAQDTAAVTTGLAQVQSAMASASQTINTNVSLNIDGRVIANEVSRYQVAMFGRGAGQ

SEQ ID NO: 1737 - protein, 443 aa, Neisseria
MSGWHTLLQDASYKGVGFDIEVVDESNGKALAEHARPFVQGIDLEDMGMTGRQVQINAVFWGKGYAGRLKKLLDALEQPGGGVLVHPVWGRMHNMIAASWSYRHEADYVDYAGIDITFREAAEAQEIFVFENAFLVELEALIANIDTYREAAIGFVDAVLAVDAGVSALWGSALGIWSAASGTFGAVRRLFDLDKIAFPDRGGYSAAAFKNGSAKLFADISVMVDTGIRREAGLADNAMHHAGWSPRQRFDGAAAVADRAAAIPDNLLTGRFSDGLQNRLNRLTAKQVQPVAQAVRLLSTSSLLSVATALIEAHGEEMTAPDLIEVNRAMRRRMQAEIAALRAVQTAAAESGGLTANAVYTEAYQTAESLRAAAGRLNALVAAVINQKPPLIVRQAPIDGTIHQIAHEFYGDIARAAELVRLNPHIHHPAFIKRGTLVNSYAK

SEQ ID NO: 1738 - protein, 169 aa, Neisseria
GLQNRLNRLTAKQVQPVAQAVRLLSTSSLLSVATALIEAHGEEMTAPDLIEVNRAMRRRMQAEIAALRAVQTAAAESGGLTANAVYTEAYQTAESLRAAAGRLNALVAAVINQKPPLIVRQAPIDGTIHQIAHEFYGDIARAAELVRLNPHIHHPAFIKRGTLVNSYAK

SEQ ID NO: 1739 - protein, 353 aa, Neisseria
MSKNAQKTLLAVCSFEVQPKDGRIQLLPYGEFRAVDGRPTDVPAWYLTEENGHDVALLANSSRNQLVVDYEHQTLYKEKNGQPAPAAGWMRWLEFTPKGMFAEVEWTDKAAAAIAAKEYRYISAVFSYDTKGYVSKIFHAALTNFPALDGMDEVLAAASAQILKPETEQNPMKELLQQLFDLPDAGEEELKAALSALVEAKPKDVALSADVFAQLAEKDSRIAALTAQTAKPDLTKYAPISVVQELQSKVAALTAKQEADKGNELITAALTSGKLLPAQKEWAKGVLKQPGGLAFLTGFIENAQPVAALAGSQTGGKAPDERVAALTAEEAAAAKMLGMSGEEFVKIKESEGK

SEQ ID NO: 1740 - protein, 352 aa, Neisseria
MSKNAQKTLLAVCSFEVQPKDGRIQLLPYGEFRAVDGRPTDVPAWYLTEENGHDVALLANSSRNQLVVDYEHTLYKEKNGQPAPAAGWMRWLEFTPKGMFAEVEWTDKAAAAIAAKEYRYISAVFSYDTKGYVSKIFHAALTNFPALDGMDEVLAAASAQILKPETEQNPMKELLQQLFGLPDAGEEELKAALSALVEAKPKDVALSADVFAQLAEKDSRIAALTAQTAKPDLTKYAPISVVQELQSKVAALTAKQEADKGNELITAALTSGKLLPAQKEWAEGVLKQPGGLAFLTGFIENAQPVAALAGSQTGGKAPDERVAALTAEEAAAAKMLGMSGEEFVKIKESEGK

SEQ ID NO: 1741 - protein, 351 aa, Neisseria
VFETPTFEQIRERILRDTKSLWPDADISPDSDHYVHASRLASCAEGQYAHQSWIVRQIFPDTADREYLERHASMRGLSRRNPTTASGTLTVSGIAQSMLSDDLQVRIGQRFYRTTARAVIGSGGTAEIPAIADEPGAAANVGDGEAQLMAAPAGVATECRLTVQGGTDRESDASLLARLLEIIRRPPAGGNRYDYKNWALSVDGVTSAYVYPLRRGLGTVDIAITSADGVSSEETVRRVQAYIDEMRPVTAKNALVLKPTVTAVPVTVQVKLDGIDLDEAKRRIRTALKEYFDTLIPGDGLTVSQIEAAISNVDGVIDRRLTAPTANRAADTVNRIEWFKAGAINVTEMPS

SEQ ID NO: 1742 - protein, 351 aa, Neisseria
VFETPTFEQIRERILRDTKSLWPDADISPDSDHYVHASRLASCAEGQYAHQSWIVRQIFPDTADREYLERHASMRGLRRRNPTTASGTLTVSGIAQSMLSDGLQVRIGQRFYRTTARAVIGSGGTAEIPAIADEPGAAANVRDGEAQLMAAPAGVSTECRLTVQGGTDRESDASLLARLLEIIRRPPAGGNRYDYKNWALSVDGVTSAYVYPLRRGLGTVDIAITSADGVPSEETVRRVQAYIDEMRPVTAKNALVLKPTVTAVPVTVQVKLDGIDLDEAKRRIRTALKEYFDTLIPGDGLTVSQIEAAISNVDGVIDLRLTAPTANRAADTVNRIEWFKAGAINVTEMPS

SEQ ID NO: 1743 - protein, 302 aa, Neisseria
MRPKPRFRRSVIACSISVITPEHLIFTVYKHNTVFARGHFFAAIIHAQLHFAFGHSTQQVEHVDFVAVADFVGNQHALSRRQTVAGNVAAKAHQDGRQILKRSSEPPQIRVDFGSGVHQRGLCDLAVNQPLVVAVGELQDFQLTETRNHILNRRVCHYSTALRCSIGSAQIAFHTASPTSARFTSRQPPSNSRPPRQNSLPSAPVLTSITSRLSAKASAARCVCCTLSSASSADSAFLSSSAFSKAVVSISTSFRAAASSACTASNSALMSSNDGAAVSAVSGLLLVFAMMTPCFRRRRIRI

SEQ ID NO: 1744 - protein, 222 aa, Neisseria
MSLSKLAKKTAQTAKNIGETLRAAFRGKITLVVSSEPIQRVQLSGLADETLQDLEHLQEYGFASHPPDGSEAVVIPLGGNTSHGVIVCSQHGSYRIKNLKPGETAIFNHEGAKIVIKQGKIIEADCDVYRVNCKQYEVNAATDAKFNAPLVETSAVLTAQGQINGNGGMAVEGGDGATFSGDVNQTGGSFNTDGDVVAGNISLRQHPHTDSIGGKTLPAEPA

SEQ ID NO: 1745 - protein, 222 aa, Neisseria; identical to SEQ ID NO: 1744

SEQ ID NO: 1746 - protein, 197 aa, Neisseria
MVRTVKSYNGEADDLAGQIHTLPAVWVTYGGSKVEPASTGGVCGRYQDTAEFVVMVAARNLRNEQAQRQGGIDSREIGSNDLIRAVRRLLDGQRLGFADSRGLVPKAVRAIANHVLVQNAAVSIYAVEYAIRFNTCGLENDRYPERTDNPDDPNHIFTKYQGTLSEPWPDFEGLDGKIYDPQSADEIPVNLTLKDKQ

SEQ ID NO: 1747 - protein, 201 aa, Neisseria
MTIYFKNGFYDDTLGGIPEGAVAVRAEEYAALLAGQAQGGQIAADSDGRPVLTPPRPSDYHEWDGKKWKISKAAAAARFAKQKTALAFRLAEKADELKNSLLAGYPQVEIDSFYRQEKEALARQADNNAPTPMLAQIAAARGVELDVLIEKVIEKSARLAVAAGAIIGKRQQLEDKLNTIETAPGLDALEKEIEEWTLNIG

SEQ ID NO: 1748 - protein, 201 aa, Neisseria
MTIYFKNGFYDDTLGSIPEGAVAVRAEEYAALLAGQAQGGQIAADSDGRPVLTPPRPSEYHEWDGKKWEIGEAAAAARFAEQKTATAFRLAAKADELKNSLLAGYPQVEIDSFYRQEKEALARQADNNAPTPMLAQIAAARGVELDVLIEKVVEKSARLAVAAGAIIGKRQQLEDKLNTIETAPGLDALEKEIEEWTLNIG

SEQ ID NO: 1749 - protein, 134 aa, Neisseria
MNLVKLLANNWQPIAIIALVGTGLAVSHHQGYKSAFAKQQAVIDKMERDKAQALLLSAQNYARELELARAEAKKYEVKAHAVGMALAKKQAEVSRLKTERDLCKIPFPPDSRNPNTGFRLFSPQIPPNFTQIPP

SEQ ID NO: 1750 - protein, 139 aa, Neisseria
MNLVKLLANNWQPIAIIALVGTGLAVSHHQGYKSAFAKQQAVIEKMKRDKAQALLLSAQNYARELEQARAEAKKYEVKAHAVGMALAKKQAEVSRLKTENKKEIENVLTQDRKNAGGGCIDGFGHHGLQLYKRALGYGN

SEQ ID NO: 1751 - protein, 377 aa, Neisseria
MFKKFKPVLLSFFALVFAFWLGTGIAYEINPRWFLSDTATEVPENPNAFVAKLARLFRNADRAVVIVKESMRTEESLAGAVDDGPLQSEKDYLALAIRLSRLKEKAKWFHVTEQEHGEEVWLDYYIGEGGLVAVSLSQRSPEAFVNAEYLYRNDRPFSVNVYGGTAHGENYETTGEYRVVWQPDGSVFDAAGRGKIGEDVYEHCLGCYQMAQVYLAKYRDVANDEQKVWDFREESNRIASDSRDYVFYQNMRELMPRGMKANSLVVGYDADGLPQKVYWSFDNGKKRQSFEYYLKNGNLFIAQSSTVALKADGVTADMQTYHAQQTWYLDGGRIIREEKQGDRLPDFPLNLEDLEKEVSRYAEAAARRSGGRRGLSH

SEQ ID NO: 1752 - protein, 377 aa, Neisseria
MFKKFKPVLLSFFALVFAFWLGTGIAYEINPRWFLSDTATEVPKNPNAFVAKLARLFRNADRAVVIVKESIRTEENLAGTVDDGPLQSEKDYLALAIRLSRLKEKAKWFHVTEQEHGKEVWLDYHIGEGGLVAVSLSQRSPEAFVNAEYLYRNDRPFSVNVYGGTVHGENYETTGEYRVVWQPDGSVFDAAGRGKIGEDVYEHCLGCYQMAQVYLAKYRDVANDEQKVWDFRKESNRIASDSRNSVFYQNMRELMPRGMKANSLVVGYDADGLPQKVYWSFDNGKKRQSFEYYLKNGNLFIAQSSTVALKADGVTADMQTYHAQQTWYLDGGRIVREEKQGDRLPDFPLNLENLEKEVRRYAEAAARRSGGRRDLSH

SEQ ID NO: 1753 - protein, 374 aa, Neisseria
MFKKFKPVLLSFFALVFAFWLGTGIAYEINPRWFLSDTATENPNAFVAKLARLFRNADRAVVIVKESMRTEESLAGAVDDGPLQSEKDYLALAVRLSRLKEKAKWFHVTEQEHGEEVWLDYYIGEGGLVAVSLSQRSPEAFVNAEYLYRNDRPFSVNVYGGTVHGENYETTGEYRVVWQPDGSVFDASGRGKIGEDVYEHCLGCYQMAQVYLAKYRDVANDEQKVWDFREESNRIASDSRDSVFYQNMRELMPRGMKANSLVVGYDADGLPQKVYWSFDNGKKRQSFEYYLKNGNLFIAQSSTVALKADGVTADMQTYHAQQTWYLDGGRIVREEKQGDRLPDFPLNLEDLEKEVSRYAEAAARRSGGRRDLSH

SEQ ID NO: 1754 - protein, 467 aa, Neisseria
MNTTLKTTLTSVAAAFALSACTMIPQYEQPKVEVAETFQNDTSVSSIRAVDLGWHDYFADPRLQKLIDIALERNTSLRTAVLNSEIYRKQYMIERNNLLPTLAANANGSRQGSLSGGNVSSSYNVGLGAASYELDLFGRVRSNSEAALQGYFASVANRDAAHLILIATVAKAYFNERYAEKAMSLAQRVLKTREETYKLSELRYKAGVISAVALRQQEALIESAKADYAHAARSREQARNALATLINRPIPEDLPAGLPLDKQFFVEKLPAGLSSEVLLDRPDIRAAEHALKQANANIGAARAAFFPSIRLTGSVGTGSVELGGLFKSGTGVWAFAPSITLPIFTWGTNKANLDVAKLRQQAQIVAYESAVQSAFQDVANALAAREQLDKAYDALSKQSRASKEALRLVGLRYKHGVSGALDLLDAERISYSAEGAALSAQLTRAENLADLYKALDGGLKRDTQTGK

SEQ ID NO: 1755 - protein, 467 aa, Neisseria
MDTTLKTTLTSVAAAFALSACTMIPQYEQPKVEVAETFKNDTADSGIRAVDLGWHDYFADPRLQKLIDIALERNTSLRTAVLNSEIYRKQYMIERNNLLPTLAANANDSRQGSLSGGNVSSSYKVGLGAASYELDLFGRVRSSSEAALQGYFASTANRDAAHLSLIATVAKAYFNERYAEEAMSLAQRVLKTREETYKLSELRYKAGVISAVALRQQEALIESAKADYAHAARSREQARNALATLINQPIPEDLPAGLPLDKQFFVEKLPAGLSSEVLLDRPDIRAAEHALKQANANIGAARAAFFPSIRLTGTVGTGSAELGGLFKSGTGVWSFAPSITLPIFTWGTNKANLDVAKLRQQVQIVAYESAVQSAFQDVANALAAREQLDKAYDALSKQSRASKEALRLVGLRYKHGVSGALDLLDAERSSYAAEGAALSAQLTRAENLADLYKALGGGLKRDTQTDK

SEQ ID NO: 1756 - protein, 467 aa, Neisseria
MDTTLKTTLTSVAAAFALSACTMIPQYEQPKVEVAETFKNDTADSGIRAVDLGWHDYFADPRLQKLIDIALERNTSLRTAVLNSEIYRKQYMIERNNLLPTLAANANDSRQGSLSGGNVSSSYKVGLGAASYELDLFGRVRSSSEAALQGYFASTANRDAAHLSLIATVAKAYFNERYAEEAMSLAQRVLKTREETYKLSELRYKAGVISAVALRQQEALIESAKADYAHAARSREQARNALATLINQPIPDDLPAGLPLDKQFFVEKLPAGLSSEVLLDRPDIRAAEHALKQANANIGAARAAFFPSIRLTGSVDTHSAELGGLFKSGTGVWLFAPSITLPIFTWGTNKANLDVAKLRQQAQIVAYEAAVQSAFQDVANALTAREQLDKAYDALSKQSRASKEALRLVGLRYKHGVSGALDLLDAERSSYSAEGAALSAQLTRAENLADLYKALGGGLKRDTQTDK

SEQ ID NO: 1757 - protein, 576 aa, Neisseria
VKPLRRLTNLLAACAVAAVALIQPALAADLAQDPFITDNTQRQHYEPGGKYHLFGDPRGSVSDRTGKINVIQDYTHQMGNLLIQQAAIQGNLGYTVRFSGHGHEEHAPFDNHAADSASEEKGNVDDGFTVYRLNWEGHEHHPADAYDGPKGGNYPKPTGARDEYTYHVNGTARSIKLNPTDTRSIRQRIFDNYNNLGSNFSDRADEANRKMFEHNAKLDRWGNSMEFVNGVAAGALNPFISAGEALGIGDILYGTRYAIDKAAMRNIAPLPAEGKFAAIGGLGSAAGFEKNTREAVDRWIQENPNAAETVEALVNVLPFAKVKNLTKAAKPGKAAVSGDFSKSYTCSFHGSTLVKTADGYKAIAHIQAGDRVLSKDEASGETGYKPVTARYGNPYQETVYIEVSDGIGNSQTLISNRIHPFYSDGKWIKAEDLKAGSRLLSESGKTQTVRNIVVKPKPLKAYNLTVADWHTYFVKGNQAETEGVWVHNDCPPKPKPTNHAQQRKEEAKNDSHRSVGDSNRVVREGKQYLDSDTGNHVYVKGDKVVILTPDGRQVTQFKNSKANTSKRVKNGKWTPK

SEQ ID NO: 1758 - protein, 467 aa, Neisseria
VKPLRRLTNLLAACAVAAAALIQPALAADLAQDPFITDNAQRQHYEPGGKYHLFGDPRGSVSDRTGKINVIQDYTHQMGNLLIQQANINGTIGYHTRFSGHGHEEHAPFDNHAADSASEEKGNVDEGFTVYRLNWEGHEHHPADAYDGPKGGNYPKPTGARDEYTYHVNGTARSIKLNPTDTRSIRQRISDNYSNLGSNFSDRADEANRKMFEHNAKLDRWGNSMEFINGVAAGALNPFISAGEALGIGDILYGTRYAIDKAAMRNIAPLPAEGKFAVIGGLGSVAGFEKNTREAVDRWIQENPNAAETVEAVFNVAAAAKVAKLAKAAKPGKAAVSGDFADSYKKKLALSDSARQLYQNAKYREALDIHYEDLIRRKTDGSSKFINGREIDAVTNDALIQAKRTISAIDKPKNFLNQKNRKQIKATIEAANQQGKRAEFWFKYGVHSQVKSYIESKGGIVKTGLGD

SEQ ID NO: 1759 - protein, 498 aa, Neisseria
VKPLRRLIKLLAACAVAAAALIQPALAADLAQDPFITDNAQRQHYEPGGKYHLFGDPRGSVSDRTGQINVIQDYTHRMGNLLIQQANINGTIGYHTRFSGHGYEEHAPFDNHAADSASEEKGNVDEGFTVYRLNWEGHEHHPADAYDGPKGGNYPKPTGARDEYTYHVNGTARSIKLNPTDTRSIRQRISDNYSNLGSNFSDRADEANRKMFEHNAKLDRWGNSMEFINGVAAGALNPFISAGEALGIGDILYGTRYAIDKAAMRNIAPLPAEGKFAVIGGLGSVAGFEKNTREAVDRWIQENPNAAETVEALVNVLPFAKVKNLTKAAKPGKAAVSGDFSAAYNTRTTRKVTTETEGLNRIRQNQKNSNIHEKNYGRDNPNHINVLSGNSIQHILYGDEAGGGHLFPGKPGKTTFPQHWSASKITHEISDIVTSPKTQWYAQTGTGGKYIAKGRPARWVSYETRDGIRIRTVYEPATGKVVTAFPDRTSNPKYNPVK

SEQ ID NO: 1760 - protein, 84 aa, Neisseria
DFRAFSCENGLSVRVRNLDGGKIALRLDGRRAVLSSDVAASGERYTAEHGLFGNGTEWHQKGGEAFFGFTDAYGNSVETSCRAR

SEQ ID NO: 1761 - protein, 126 aa, Neisseria
MNIRFFALTVPVLSLAACAVPEAYDDGGRGHMPPVQNQAGTDDFRAFSCENGLSVRVRHLDSGKVALRLDGRRAVLSSDVAASGERYTAEHGLFGNATEWHQKGGEAFFGFTDAYGNSVETSCRAR

SEQ ID NO: 1762 - protein, 126 aa, Neisseria
MNIRFFALTVPVLSLAACAVPEAYDDGGRGHMPPVQNQAGTADFRAFSCENGLSVHVRRLDGGRIALRLDGRRAVLSSDVAASGERYTAEHGLFGNGTEWHQKGGEAFFGFTDAYGNSVETSCRAR

SEQ ID NO: 1763 - protein, 491 aa, Neisseria
MSKPVFKKIALYTLGAISGVAVSLAVQGFAAEKDGRDNEVLPVQSIRTMAEVYGQIKANYYHDKPDADLFEGAMKGMVAGLDPHSEYMDKKGYAEIKESTSGEFGGLGMEIGQEDGFVKVVSPIEDTPAERAEVKSGDFIVKIDNVSTRGMTVSEAVKKMRGKPGTKITLTLSRKNADKPIVVNLTRAIIKVKSVRHHLIEPDYGYIRVSQFQERTVESVNTAAKELVKENKGKPLKGLVLDLRDDPGGLLTGAVGVSAAFLPSEAVVVSTKGRDGKDGMVLKAVPEDYVYGMGGDPLAGIPAELKTIPMTVLVNSGSASASEIVAGALQDHKRAVIVGTQSFGKGSVQTLIPLSNGSAVKLTTALYYTPNDRSIQAQGIVPDVEVKDKERTFESREADLVGHIGNPLGGEDVNSETLAVPLEKDADKPAAKEKGKKKKDEDLSSRRIPNPAKDDQLRKALDLVKSPEQWQKSLGLAAKKPVSNKDKKDKK

SEQ ID NO: 1764 - protein, 494 aa, Neisseria
MSKPVFKKIALYTLGAISGVAVSLAVQGFAAEKDRRDNEVLPVQSIRTMAEVYGQIKANYYQDKPDADLFEGAMKGMVAGLDPHSEYMDKKGYAEIKESTSGEFGGLGMEIGQEDGFVKVVSPIEDTPAERAGVKSGDFIVKIDNVSTRGMTVSEAVKKMRGKPGTKITLTLSRKNADKPIVVNLTRAIIKVKSVRHHLIEPDYGYIRVSQFQERTVESVNTAAKELVKENKGKPLKGLVLDLRDDPGGLLTGAVGVSAAFLPSEAVVVSTKGRDGKDRMVLKAIPEDYVYGMGGDSLAGIPAELKTIPMTVLVNSGSASASEIVAGALQDHKRAVIVGTQSFGKGSVQTLIPLSNGSAVKLTTALYYTPNDRSIQAQGIVPDVEVKDKERIFESREADLVGHIGNPLGGEDVNGETLAVPLEKDADKPAVKEKGKKKKDEDLSSRRIPNPAKDDQLRKALDLVKSPEQWQKSLGLAAKKPVSNKDKKDKKDKK

SEQ ID NO: 1765 - protein, 494 aa, Neisseria
MSKPVFKKIALYTLGAISGVAVSLAVQGFAAEKDRRDNEVLPVQSIRTMAEVYGQIKANYYQDKPDADLFEGAMKGMVAGLDPHSEYMDKKGYAEIKESTSGEFGGLGMEIGQEDGFVKVVSPIEDTPAERAGVKSGDFIVKIDNVSTRGMTVSEAVKKMRGKPGTKITLTLSRKNADKPIVVNLTRAIIKVKSVRHHLIEPDYGYIRVSQFQERTVESVNTAAKELVKENKGKPLKGLVLDLRDDPGGLLTGAVGVSAAFLPSEAVVVSTKGRDGKDRMVLKAVPEDYVYGMGGDSLAGIPAELKTIPMTVLVNSGSASASEIVAGALQDHKRAVIVGTQSFGKGSVQTLIPLSNGSAVKLTTALYYTPNDRSIQAQGIVPDVEVKDKERIFESREADLVGHIGNPLGGEDVNSETLAVPLEKDADKPAVKEKGKKKKDEDLSSRRIPNPAKDDQLRKALDLVKSPEQWQKSLGLAAKKPVSNKDKKDKKDKK

SEQ ID NO: 1766 - protein, 123 aa, Neisseria
MMNPKTLGRLSLCAAVLALTACAGGGHKNLYYYGGYPDTVYEGLKNDDTSLGKQTEKMEKYFAEAANKKMNAAPGAHAHLGLLLSRSGDKEGAFRQFEEEKRLFPESGVFMDFLMKTGKGGKR

SEQ ID NO: 1767 - protein, 123 aa, Neisseria
MMNPKTLSRLSLCAAVLALTACGGNGQKSLYYYGGYPDTVYEGLKNDDTSLGKQTEKMEKYFVEAGNKKMNAAPGAHAHLGLLLSRSGDKEGAFRQFEEEKRLFPESGVFMDFLMKTGKGGKR

SEQ ID NO: 1768 - protein, 123 aa, Neisseria; identical to SEQ ID NO: 1767

SEQ ID NO: 1769 - protein, 160 aa, Neisseria
MMKKILAVSALCLMTAAAQAADTYGYLAVWQNPQDANDVLQVKTTKEDSAKSEAFAELEAFCKGQDTLAGIAEDEPTGCRSVVSLNNTCVSLAYPKALGAMRVENAVVITSPRFTSVHQVALNQCIKKYGAQGQCGLETVYCTSSSYYGGAVRSLIQHLK

SEQ ID NO: 1770 - protein, 92 aa, Neisseria
SGIAEDEPTGCRSVVSLNNTCVALAYPKALGALRVDNAVVITSPRFTSVHQVALNQCIKKYGVQGQCGLETVYCTSSSYYGGTVRSLIQNLK

SEQ ID NO: 1771 - protein, 160 aa, Neisseria
MMKKILAVSALCLMTAAARAADTYGYLAVWQNPQNANDVLQVKTTKEDSTKSEAFAELEAFCKGQDTLAGIAEDEPTGCRSVVSLNNTCVALAYPKALGAMRVENAVVITSPRFTSVYQVALNQCIKKYGAQGQCGLETVYCTSSSYYGGTVRSLIQNLK

SEQ ID NO: 1772 - protein, 139 aa, Neisseria
MNLVKLLANNWQPIAIIALVGTGLAVSHHQGYKSAFAKQQAVIDKMERDKAQALLLSAQNYARELELARAEAKKYEVKAHAVGMALAKKQAEVSRLKTENKKEIENVLTQDRKNASGGCIDGFGSHGLQLYNRALGYGN

SEQ ID NO: 1773 - protein, 139 aa, Neisseria; identical to SEQ ID NO: 1750

SEQ ID NO: 1774 - protein, 258 aa, Neisseria
MNFIRSVGAKTLGLIQSFGSITLFLLNILAKSGTAFARPRLSVRQVYFAGVLSVLIVAVSGLFVGMVLGLQGYTQLSKFKSADILGYMVAASLLRELGPVLAAILFASSAGGAMTSEIGLMKTTGQLEAMNVMAVNPVARVVAPRFWAGVFSMPLLASIFNVAGIFGAYLVGVSWLGLDSGIFWPQMQNNITIHYDVINGLIKSAAFGVAVTLIAVHQGFHCIPTSEGILRASTRTVVSSALTILAVDFILTAWMFTD

SEQ ID NO: 1775 - protein, 258 aa, Neisseria
MNFIRSVGAKTLGLIQSLGSITLFLLNILAKSGTAFVRPRLSVRQVYFAGVLSVLIVAVSGLFVGMVLGLQGYTQLSKFKSADILGYMVAASLLRELGPVLAAILFASSAGGAMTSEIGLMKTTEQLEAMNVMAVNPVARVVAPRFWAGVFSMPLLASIFNVAGIFGAYLVGVTWLGLDSGIFWSQMQNNITIHYDVINGLIKSAAFGVAVTLIAVHQGFHCVPTSEGILRASTRTVVSSALTILAVDFILTAWMFTD

SEQ ID NO: 1776 - protein, 258 aa, Neisseria; identical to SEQ ID NO: 1775

SEQ ID NO: 1777 - protein, 108 aa, Neisseria
MNIKHLLLTAAATALLGISAPALAHHDGHGDDDHGHAAHQHGKQDKIISRAQAEKAAWARVGGKITDIDLEHDDGRPHYDVEIVKNGQEYKVVVDARTGRVISSRRDD

SEQ ID NO: 1778 - protein, 108 aa, Neisseria
MNIKHLLLTSAATALLSISAPALAHHDGHGDDDHGHAAHQHNKQDKIISRAQAEKAALARVGGKITDIDLEHDNGRPHYDVEIVKNGQEYKVVVDARTGRVISSRRDD

SEQ ID NO: 1779 - protein, 108 aa, Neisseria
MNFKRLLLTAAATALMGISAPALAHHDGHGDDDHGHAAHQHSKQDKIISRAQAEKAALARVGGKITDIDLEHDNGRPHYDVEIVKNGQEYKVVVDARTGRVISSRRDD

SEQ ID NO: 1780 - protein, 604 aa, Neisseria
MSAETTVSGARPAAKLPIYILPCFLWIGIIPFTFALRLKPSPDFYHDAAAAAGLIVLLFLTAGKKLFDVKIPAISFLLFAMAAFWWLQARLMNLIYPGMNDIASWVFILLAVSAWACKSLVAHYGQERIVTLFAWSLLIGSLLQSCIVVIQFAGWENTPLLQNIIVHRGQGVIGHIGQRNNLGHYLMWGILASAYLNGQRKIPAALGAICLIMQTAVLGLVNSRTILTYIAAIALILPFWYFRSDKSNRRTMLGIAAAVFLTALFQFSMNAILETFTGIRYETAVERVANGGFTDLPRQSEWNKALAAFQSAPIFGHGWNSFAQQTFLINAEQHTIHDNFLSTLFTHSHNIILQLLAEMGISGTLLVAATLLTGIAGLLKRSLTPASLFLLCALAVSMCHSMLEYPLWYVYFLIPFGLMLFLSPAEASDGIAFKKAANLGILTASAAIFAGLLHLDWTYTRLVNSFSPAADDSAKTLNRKINELRYISANSPMLSFYADFSLVNFALPEYPETQTWAEEATLKALKYRPYSATYRIALYLMRQGKVAEAKQWMRATQSYYPYLMPRYADEIRKLPVWAPLLPELLKDCKAFAAAPGHPETKPCK

SEQ ID NO: 1781 - protein, 604 aa, Neisseria
MPAETTVSGAHPAAKLPIYILPCFLWIGIVPFTFALKLKPSPDFYHDAAAAAGLIVLLFLTAGKKLFDVKIPAISFLLFAMAAFWYLQARLMNLIYPGMNDIVSWIFILLAVSAWACRSLVAHFGQERIVTLFAWSLLIGSLLQSCIVVIQFAGWEDTPLFQNIIVYSGQGVIGHIGQRNNLGHYLMWGILAAAYLNGQRKIPAALGVICLIMQTAVLGLVNSRTILTYIAAIALILPFWYFRSDKSNRRTMLGIAAAVFLTALFQFSMNTILETFTGIRYETAVERVANGGFTDLPRQIEWNKALAAFQSAPIFGHGWNSFAQQTFLINAEQHNIYDNLLSNLFTHSHNIVLQLLAEMGISGTLLVAATLLTGIAGLLKRPLTPASLFLICTLAVSMCHSMLEYPLWYVYFLIPFGLMLFLSPAEASDGIAFKKAANLGILTASAAIFAGLLHLDWTYTRLVNAFSPATDDSAKTLNRKINELRYISANSPMLSFYADFSLVNFALPEYPETQTWAEEATLKSLKYRPHSATYRIALYLMRQGKVAEAKQWMRATQSYYPYLMPRYADEIRKLPVWAPLLPELLKDCKAFAAAPGHPEAKPCK

SEQ ID NO: 1782 - protein, 604 aa, Neisseria
MPAETTVSGAHPAAKLPIYILPCFLWIGIVPFTFALRLQPSPDFYHDAAAAAGLIVLLFLTAGKKLFDVKIPPISFLLFAMAAFWYLQARLMNLIYPGMNDIVSWIFILLAVSAWACRSLVAHYGQERIVTLFAWSLLIGSLLQSCIVVIQFAGWEDTPLFQNIIVYSGQGVIGHIGQRNNLGHYLMWGILAAAYLNGQRKIPPALGAICLIMQTAVLGLVNSRTILTYIAAIALILPFWYFRSDKSNRRTILGIAAAVFLTALFQFSMNTILETFTGIRYETAVERVANGGFTDLPRQIEWRKALAAFQSAPIFGHGWNSFAQQTFLINAEQHNIHDNLLSNLFTHSHNIVLQLLAEMGISGTLLVAATLLTGIAGLLKRPLTPASLFLICTLAVSMCHSMLEYPLWYVYFLIPFGLMLFLSPAEASDGIAFKKAANLGILTASAAIFAGLLHLDWTYTRMVNAFSPATDDSAKTLNRKINELRYISANSPMLSFYADFSLVNFALPEYPETQTWAEEATLKSLKYRPHSATYRIALYLMRQGKVAEAKQWMRATQSYYPYLMPRYADEIRKLPVWAPLLPELLKDCKAFAAAPGHPEAKPCK

SEQ ID NO: 1783 - protein, 197 aa, Neisseria
MAKKPNKPFRLTPKLLIRAVLLICITAIGALAVGIVSTFNPNGDKTLQTEPQHTDSPRETEFWLPNGAVGQDAAQPEHHHAASSEPAQPDGTEESGSGLPSPAAPKKNRVKPRPSDAARAADSLTGTGTQAENTLKETPVLPTNAPHPEPRKETPEKQAQPKETPKEKETPKENHTKPDTPKNTPAKPHKEILDNLF

SEQ ID NO: 1784 - protein, 191 aa, Neisseria
MAKKPNKPFRLTPKLLIRAVLLICIAAIGALAIGIVSTFNPNGDKTLQAEPQHTDSPRETEFWLPNGVVGQDAAQPEHHHAASSEPAQPDGTDESGSGLPSPAAPKKNRVKPQPADTAQTDRQPDDAGTQAENTLKETPVLPTNVPRPEPRKETPEKQAQPKETPKENHTKPDTPKNTPPKPHKEILDKLF

SEQ ID NO: 1785 - protein, 197 aa, Neisseria
MAKKPNKPFRLTPKLLIRAVLLICITAIGALAIGIVSTFNPNGDKTLQTEPQHTDSPRETEFWLPNGVVGQDAAQPEHHHASSSAPAQPDGTDESGSGLPSPAAPKKNRVKPQPADTAQTDRQPDDAGAQAENTLKETPVLPTNVPRPEPRKETPEKQAQPKETPKEKETPKENHTKPDTPKNTPPKPHKEILDNLF

SEQ ID NO: 1786 - protein, 92 aa, Neisseria
MSRNLLVRWLAVCLIPLATLAVFAANPPEDKPQHLINGIILACEATFLFKFVLFETIKHHLKQGFDLKRQTMFLFIPIVLLVVYLFHYFGAF

SEQ ID NO: 1787 - protein, 92 aa, Neisseria
MSRNLLVRWLAVCLIPLATLAVFAANPPEDKLQHLINGIILACEATFLFKFVLFDTIKHHLKQEFDLKRQTMLLFIPIILLIVYLFHYFGAF

SEQ ID NO: 1788 - protein, 92 aa, Neisseria
MSRNLLVRWLVVCLIPLATLAVFAANPPEDKPQHLINGIILACEATFLFKFVLFDTIKHHLKQEFDLKRQTMLLFIPIILLIVYLFHYFGAF

SEQ ID NO: 1789 - protein, 279 aa, Neisseria
VNRTTFCCLSLTAGPDSDRLQQRRGGGGGVAADIGTGLADALTAPLDHKDKGLKSLTLEASIPQNGTLTLSAQGAEKTFKAGGKDNSLNTGKLKNDKISRFDFVQKIEVDGQTITLASGEFQIYKQDHSAVVALRIEKINNPDKIDSLINQRSFLVSDLGGEHTAFNQLPDGKAEYHGKAFSSDDADGKLTYTIDFAAKQGHGKIEHLKTPEQNVELASAELKADEKSHAVILGDTRYGGEEKGTYRLALFGDRAQEIAGSATVKIGEKVHEIGIADKQ

SEQ ID NO: 1790 - protein, 274 aa, Neisseria
VNRTAFCCLSLTTALILTACSSGGGGVAADIGAGLADALTAPLDHKDKGLQSLTLDQSVRKNEKLKLAAQGAEKTYGNGDSLNTGKLKNDKVSRFDFIRQIEVDGQLITLESGEFQVYKQSHSALTAFQTEQIQDSEHSGKMVAKRQFRIGDIAGEHTSFDKLPEGGRATYRGTAFGSDDAGGKLTYTIDFAAKQGNGKIEHLKSPELNVDLAAADIKPDGKRHAVISGSVLYNQAEKGSYSLGIFGGKAQEVAGSAEVKTVNGIRHIGLAAKQ

SEQ ID NO: 1791 - protein, 274 aa, Neisseria
VNRTAFCCLSLTAALILTACSSGGGGVAADIGAVLADALTAPLDHKDKSLQSLTLDQSVRKNEKLKLAAQGAEKTYGNGDSLNTGKLKNDKVSRFDFIRQIEVDGQLITLESGEFQVYKQSHSALTALQTEQVQDSEHSGKMVAKRQFRIGDIAGEHTSFDKLPEGGRATYRGTAFGSDDASGKLTYTIDFAAKQGHGKIEHLKSPELNVDLAASDIKPDKKRHAVISGSVLYNQAEKGSYSLGIFGGQAQEVAGSAEVETANGIRHIGLAAKQ

SEQ ID NO: 1792 - protein, 783 aa, Neisseria
MVYGIAEADAGDSSVLTLGGMYQKSREVPDFSGIILPCENQKTAPFSSTPACNRPLQLPRNTYLGEDWSRLSADKYNLFSGFKHVFDNGWQLNAEVSYTKNESDAKVGQFFLKNEYAAGLSGEDAVGFLTEKNEVIPFEPKDKALEKLKAYRDETAKEYRERKDDFVKNRFDNTAFEQYRSRRAAERKAGFDKCMSDPFALDFICQGSWGDPGVDADKAEFVDKALAKEGIFNNAAQRFPNSLYDSSFNRKATANRRYSYMPLRHTKDDRQWGIKLDLTGTYGLFGREHDFFVGYAYGDEKIRSEYLEIYERRYRVRPNTGATHGVYAGSCQEEPDGDLSSPLVRGHKEPDWQAYDEKGNRTVYAEECRNAKKIKTEPKLDAEGKQVYYYDEYSGSRTPVYVDVYELDEKGNKIQETNPDGTPAFTGFSGTVPVWKTVKVADDHVPALYNYAKYLNTNKTHSLTASTRFNVTGRLHLLGGLHYTRYETSQTKDMPVRYGQPASDFQTASSIRADQDHYTAKMQGHKLTPYAGITYDLTPQQSIYGSYTKIFKQQDNVDVSAKTVLPPLVGTNYEVGWKGAFLQGRLNASFALFYLEQKNRTVVDFGYVPGAGGKQGSFQTVAKPIGKVVSRGAEFELSGELNEDWKVFAGYTYNKSRYKNAAEVNAERLAKNSSADPYNFSNFTPVHIFRFGTSFHIPNTGLTVGGGVSAQSGTSSLYNIRQGGYGLIDGFVRYELGKHAKLSLIGTNLNGRTYFENNYNRTRGANNFYGEPRTVSMKLDWQF

SEQ ID NO: 1793 - protein, 783 aa, Neisseria
MVYGIAEADAGDSSVLTLGGMYQKSREVPDFSGIILSCENQKTAPFSSTPACNRPLQLPRNTYLGEDWSRLSADKYNLFSGFKHVFDNGWQLNAEVSYTKNESDAKVGQFFLKNEHAAGLSDEDAVGFLTEKNEVIPFEPKDKALEKLKAYRDETAKEYRERKDDFVKNRFDNTAFEQYRSRRAAERKAGFDECMSAPFALDFICQGSWGDPGVDADKSEFVDKALAKEGIFNNAAQRFPNSLYDSSFNRKATANRRYSYMPLRHTKDDRQWGIKLDLTGTYGLFGREHDFFVGYAYGDEKIRSEYLEIYERRHRVRPNTGATHGVYAGSCQGEPDGDLSSPLVRGHKEPDWQAYDEKGNRTVYAEECRNAKKIKTEPKLDAEGKQVYYYDEYSGSRTPVYVDVYELDEKGNKIQETNPDGTPAFTGFSGTVPVWKTVKVADDHVPALYNYAKYLNTNKTHSLTAGTRFNVTGRLHLLGGLHYTRYETSQTKDMPVRYGQPASDFQTASSIKADQDHYTAKMQGHKLTPYAGITYDLTPQQSIYGSYTKIFKQQDNVDVSAKTVLPPLVGTNYEVGWKGAFLQGRLNASFALFYLEQKNRTVVDFGYVPGAGGKQGSFQTVAKPIGKVVSRGAEFELSGELNEDWKVFAGYTYNKSRYKNAAEVNAERLAKNTGADPYNFSNFTPVHIFRFGTSFHIPNTGLTVGGGVSAQSGTSSLYNIRQGGYGLIDGFVRYELGKHAKLSLIGTNLNGRTYFENNYNRTRGANNFYGEPRTVSMKLDWQF

SEQ ID NO: 1794 - protein, 187 aa, Neisseria
MNQNHFSLKILTVMLLSAYGGSFADGVVPVSDGNTVSLDTVNVRGSHALLGKTEKTRSYTIDRMSTATGMRIAGKDTPQSVSVITRSRLDDKAVHTLEEAMKNTTGVNVVRDSGLQTRFLSRGFYIDQIGEDGMTVNVAGRSGYTAKIDVSPSTDLAVYDHIEVVRGATGLTQSNSEPGGTVNLIRK

SEQ ID NO: 1795 - protein, 188 aa, Neisseria
MNQNHFSLKILTVMLLSAYGGSFADGVVPVSDGNTVSLDTVNVRGSHALSGKTEKTRSYTIDRMSTATGMRIAGKDTPQSVSVITRSRLDDKAVHTLEEAMKNTTGVNVVRDSGLQTRFLSRGFYIDQIGEDGITVNVAGRSGYTAKIDVSPSTDLAVYDHIEVVRGATGLTQSNSEPGGTVNLIRKR

SEQ ID NO: 1796 - protein, 531 aa, Neisseria
MKPLKTLEFGFVDAANYRRRENKDLFNRIFVKGEYLDELCEPNISFLIGEKGTGKTAYAVYLTNNFYKNIHATTKFVRETDYSKFIQLKKARHLTVSDFTSIWKVILYLLISNQIKCKENGILSSIFNKFKALDEAINEYYYGAFDPEIVQAITLIENSKEAAEMIFGKFVKLGEEESQQITFTESKFQANLGFIERKFKDALSQLKLKDNHILFIDGIDIRPSQIPFDEYHECVKGLANAIWMLNNDIFPSIKDSKGRMRVVLLIRPDIFDSLGLQNQNTKLQDNSVFLDWRTDYKSYRSSKIFGVFDHLLRTQQEKQDSLEKGNSWDYYFPWNAPNLHDEYKNLTSFISFLRKSYYRPRDILQMLTLLQKNKKSKEDYVVAEDFDNTSFQREYSIYLLGEIKDHLLFYYSQSDYQNFLKFFEFLNGKDRFKYSDFLKAFERLKKHLQTTSVEIPKFMSTANEFLQFLFDLNVIAYLDNPEDETKPYIHWCFKDRNYANISPKIKTETEYLIFSGLSKALDVGTPFKNKQ

SEQ ID NO: 1797 - protein, 163 aa, Neisseria
MFWQLTVVSVTAVIALGTIFINKKTSKQKATLDVILNDYQDAQFVEADNHISPYIRGTAVDDNNARIDLYEIYQNKGGQWEKERGHLLTVINRHEFYACAINSGVLDEDLFKRLHCTNFIKLWNAVSPLVMKIREEERKDTIFRELEILVALWKANPLKASDL

SEQ ID NO: 1798 - protein, 346 aa, Neisseria
MSENKQNEVLTGYEQLKRRNRRRLVTASSLVAASCILLAAALSSDPADSNPAPQAGETGATESQTANTAQTPALKSAAENGETAADKPQDLAGEDKPSAADSEISEPENVGAPLVLINDRLEDSNIKGLEESEKLQQAETAKTEPKQAKQRAAEKVSATADSTDTVAVEKPKRTAEPKPQKAERTAEAKPKAKETKTAEKVADKPKTAAEKTKPDTAKSDSAVKEAKKADKAEGKKTAEKDRSDGKKHETAQKTDKADKTKTAEKEKSGKAGKKAAIQAGYAEKERALSLQRKMKAAGIDSTITEIMTDNGKVYRVKSSNYKNARDAERDLNKLRVHGIAGQVTNE

SEQ ID NO: 1799 - protein, 332 aa, Neisseria
MSENKQNEVLSGYEQLKRRNRRRLVTASCLVAASCILLAAALSSGPAEQTAGETSGVENKAAGAAQTPALKSAADKPQDLAGEDKPSAADSEISEPENVGAPLVLINERLEDSNIKGLEASEKLQQAETAKTAPKQAKQRAAEKVPATADSTDTVAVEKPKRTAETKPQKAERTAKAKPKAKETKTAEKVADKPKTAAEKTKPDTAKSDSAVKEAKKADKAESKKTAEKDRSDGKKHETAQKTDKADKTKTAEKEKSGKKAAIQAGYAEKERALSLQRKMKAAGIDSTITEIMTDNGKVYRVKSSNYKNARDAERDLNKLRVHGIAGQVTNE

SEQ ID NO: 1800 - protein, 332 aa, Neisseria
MSENKQNEVLSGYEQLKRRNRRRLVTASCLVAASCILLAAALSSGPAEQTAGETSGVENKAAGAAQTPALKSAADKPQDLAGEDKPSAADSEISEPENVGAPLVLINDRLEDSNIKGLEASEKLQQAETAKTAPKQAKQRAAEKVPATADSTDTVAVEKPKRTAETKPQKAERTAKAKPKAKETKTAEKVADKPKTAAEKTKPDTAKSDSAVKEAKKADKAESKKTAEKDRSDGKKHETAQKTDKADKTKTAEKEKSGKKAAIQAGYAEKERALSLQRKMKAAGIDSTITEIMTDNGKVYRVKSSNYKNARDAERDLNKLRVHGIAGQVTNE

SEQ ID NO: 1801 - protein, 102 aa, Neisseria
LTPWADAYADLRGKTKVMTTQMGASRDVSKSAKGWSVGIGLNVGKQLTDSVGLEFDPYYRHKTIYKPREIVLDGDKTKMGRSKSNEYGFRVAATFYSQLKSK

SEQ ID NO: 1802 - protein, 102 aa, Neisseria
LTPWADAYADLRGKTKVMTTQMCASRDVSKSAKGWSVGIGLNVGKQLTDSVGLEFDPYYRHKTICKPREIVLDGDKTKMGRSKSNEYGFRVTATFYSQLKSK

SEQ ID NO: 1803 - protein, 421 aa, Neisseria
MSQNQPAQPTKRNLFKTALAVGAIGAIGGYFGGKKQGETAERTAESQHSPQAYPCYGEHQAGIVTPRQAFSIMCAFDVTAQSAKQLENLFRTLTARIEFLTQGGEYQDGDDKLPSAGSGILGKAFNPDGLTVTVGVGSSLFDGRFGLKDKKTVHLQEMRDFPNDKLQKSWCDGDLSLQICAFTPETCQTALRDIIKHTAQTAVIRWSIDGWQPKSEPGAMAARNLLGFRDGTGNPKVSDPKTADEVLWTGVAANSLDEPEWAKNGSYQAVRLIRRFVEFWDRTPLQEQTDIFGRRKYSGAPMDGKKEADQPDFAKDPEGDITPKDSHMRLANPRDPEFLKKHCLFRRAYSYSRGPASSGQLDVGLVFVCYQANLADGFIFVQNLLNGEPLEEYISPFGGGYFFVLPGVGKGGFLGQGLPGV

SEQ ID NO: 1804 - protein, 421 aa, Neisseria
MSKKQPAQPTRRTLFKTAIAAGAVGAIGGYLGGKKQGETAERTAESQHSPQAYPCYGEHQAGIVTPQQAFSIMCAFDVTAQSAKQLENLFRTLTARIEFLTQGGEYQDGDDKLPPAGSGILGKAFNPDGLTVTVGVGSSLFDGRFGLKDKKPIHLQEMRDFSNDKLQKSWCDGDLSLQICAFTPETCQAALRDIIKHTVQTAVIRWSIDGWQPKSEPGAMAARNLLGFRDGTGNPKVSDPKTADEVLWTGVAANSLDEPEWAKNGSYQAVRLIRHFVEFWDRTPLQEQTDIFGRRKYSGAPMDGKKEADQPDFAKDPEGDITPKDSHIRLANPRDPEFLKKHRLFRRAYSYSRGLASSGQLDVGLVFVCYQANLADGFIFVQNLLNGEPLEEYISPFGGGYFFVLPGVEKGGFLGQGLLGV

SEQ ID NO: 1805 - protein, 421 aa, Neisseria
MSKNQPAQPTRRTLFKTAIAAGAVGAIGGYLGGKKRGETAERTAESQHSPQAYPCYGEHQAGIVTPQQAFSIMCAFDVTAQSAKQLENLFRTLTARIEFLTQGGEYQDGDDKLPPAGSGILGKAFNPDGLTVTVGVGSSLFDGRFGLKDKKPIHLQEMRDFSNDKLQKSWCDGDLSLQICAFTPETCQAALRDIIKHTVQTAVIRWSIDGWQPKSEPGAMAARNLLGFRDGTGNPKVSDPKTADEVLWTGVAANSLDEPEWAKNGSYQAVRLIRHFVEFWDRTPLQEQTDIFGRRKYSGAPMDGKKEADQPDFAKDPEGNTTPKDSHIRLANPRDPEFLKKHRLFRRAYSYSRGLASSGQLDVGLVFVCYQANLADGFIFVQNLLNGEPLEEYISPFGGGYFFVLPGVEKGGFLGQGLLGV

SEQ ID NO: 1806 - protein, 388 aa, Neisseria
MRKFNLTALSVMLALGLTACQPPEAEKAAPAASGETQSANEGGSVGIAVNDNACEPMNLTVPSGQVVFNIKNNSGRKLEWEILKGVMVVDERENIAPGLSDKMTVTLLPGEYEMTCGLLTNPRGKLVVADSGFKDTANEADLEKLPQPLADYKAYVQGEVKELAAKTKTFTEAVKAGDIEKAKSLFAATRVHYERIEPIAELFSELDPVIDACEDDFKDGAKDAGFTGFHRIEHALWVEKDVSGVKETAAKLMTDVEALQKEIDALAFPPGKVVGGASELIEEAAGSKISGEEDRYSHTDLSDFQANADGSKKIVDLFRPLIEAKNKALLEKTDTNFKQVNEILAKYRTKDGFETYDKLSEADRKALQAPINALAEDLAQLRGILGLK

SEQ ID NO: 1807 - protein, 388 aa, Neisseria; identical to SEQ ID NO: 1456

SEQ ID NO: 1808 - protein, 388 aa, Neisseria; identical to SEQ ID NO: 1457

SEQ ID NO: 1809 - protein, 323 aa, Neisseria
VKPRFYWAACAVLPAACSPEPAAEKTVSAASQAASTPVATLTVPTARGDAVVPKNPERVAVYDWAALDTLTEPGVNVGATTAPVRVDYLQPAFDKAATVGTLFEPDCESLHRHNPQFVITGGPGAEAYEQLAKNATTIDLTVDNGNIRTSGEKQMETLSRIFGKEARVAELNAQIDALFAQKREAAKGKGRGLVLSVTGNKVSAFGTQSRLASWIHGDIGLPPVDESLRNEGHGQPVSFEYIKEKNPGWIFIIDRTAAIGQEGPAAVEVLDNALVCGTNAWKRKQIIVMPAANYIVAGGARQLIQAAEQLKAAFEKAEPVAAQ

SEQ ID NO: 1810 - protein, 321 aa, Neisseria
VKPRFYWAACAVLLTACSPEPAAEKTVSAASASAATLTVPTARGDAVVPKNPERVAVYDWAALDTLTELGVNVGATTAPVRVDYLQPAFDKAATVGTLFEPDYEALHRYNPQLVITGGPGAEAYEQLAKNATTIDLTVDNGNIRTSGEKQMETLARIFGKEARAAELKAQIDALFAQTREAAKGKGRGLVLSVTGNKVSAFGTQSRLASWIHGDIGLPPVDESLRNEGHGQPVSFEYIKEKNPDWIFIIDRTAAIGQEGPAAVEVLDNALVRGTNAWKRKQIIVMPAANYIVAGGARQLIQAAEQLKAAFKKAEPVAAGKK

SEQ ID NO: 1811 - protein, 321 aa, Neisseria
VKPRFYWAACAVLLTACSPEPAAEKTVSAASASAATLTVPTARGDAVVPKNPERVAVYDWAALDTLTELGVNVGATTAPVRVDYLQPAFDKAATVGTLFEPDYEALHRYNPQLVITGGPGAEAYEQLAKNATTIDLTVDNGNIRTSGEKQMETLARIFGKEARAAELKAQIDALFAQTREAAKGKGRGLVLSVTGNKVSAFGTQSRLASWIHGDIGLPPVDESLRNEGHGQPVSFEYIKEKNPDWIFIIDRTAAIGQEGPAAVEVLDNALVRGTNAWKRKQIIVMPAANYIVAGGSRQLIQAAEQLKEAFEKAEPVAAGKE

SEQ ID NO: 1812 - protein, 337 aa, Neisseria
MAWSMFATTQADRAVRSATAPKEMWFHKKIIDEKTGKVSFDTRQIWSLNDLSKEELASIQDTNGKVITVSNPGIFNNREDSLSNAAKQNRNSTNGSGVIAVMNPPTGKYKSDSNNKIKDFLWLGSSLVSELMYVGYDQLNNKVFQGYLPKTNSEKLNQDIYREVQKMGNGWSVDTSNHSRGGITASVSLKDWVNNQKQNGIAPIRKARFYGTATNVQNDYADVLQKNGYTYTGADGKTYNSGSYSIVHDKDFVGNKWIPFLLGTNDTTQGTCKGLCYSHSSYFAEVPKAGTKEFDDYVKIWGEVEYDAQGKPINKSKPILVEPNKTKDNEKYEKEAF

SEQ ID NO: 1813 - protein, 470 aa, Neisseria
MKISRPPEFTLLQQEYMQHLTERMTQIAKLLNSSANNPDIDIPDFLTEIKDYSEFSVTDENGTYLHWDKFRRIHTEDTRMKWRAVKESRKKIQKPIDFPFEHQFWFCIPDSLQARLHLIDKSCGSSIGTSSLGGFGRSEQNRFLLKSLIMEEAITSAQLEGAATTRKVAKDMLKSQRKPKTKDEIMIVNNYHLMKKAVELKNTPLSVEMILDLHRIATSNAIENKAEPGQFRQDDEIFIADINGNSLYQPPPHGQVHTLMEEVCAFANNTYDGVENPFIHPVVQAIILHFLIGYIHPFGDGNGRTARALFYWFMLKNGYWLFEYISISRLLKNAPAQYAKSYLYAETDDLDLTYFIYYQCDIIKRAVADLEHYISDKQKHQQEFKAAIAQYTEKIGKLNQRQIGILQKAVEESGKIFTAQEIANQYGISLNTARSDLSKLGEYRFLVPFKSGNALEYVAPQDLLERLEKK

SEQ ID NO: 1814 - protein, 470 aa, Neisseria; identical to SEQ ID NO: 1813

SEQ ID NO: 1815 - protein, 152 aa, Neisseria
MPITPPLNIISPKLYPNEQWNESEALGAITWLWYQSPTHRQVPIVEMMTYILPVLKNGQFALFCKGTQPIGYISWAYFDEVAQAHYLESDRHLRDNSDWNCGDNIWLIQWFAPLGHSHQMRSAVRQLFPSTTVRALYHKGSDKGLRILTFKT

SEQ ID NO: 1816 - protein, 429 aa, Neisseria
MMKSILTVSGNRMRKPRITYLDVWANDERIGTLEKGAMYRFAYDNPNSSLLGLHYQDRSKVYISNNMPHIFAQYFPEGFLDAHITSKYAFHDAPFEDNEMLRLAILCRETLGRIHVRCNDPLFNEWIDGLEMKNPRILTERDLLGINARQVFQQYMAEIFHHGRFVSVSGIQQKMSLDAIRRNTKQTASYIAKGFDASEYPCLAANEFLCMQTIKQAGIAVAQTSLSEDSSVLLVRRFDVSEQGYFLGMEDFTSLRQYSVEDKYKGSYAAIAQIIRQISGRPDEDLIHFFNQLAASCILKNGDAHLKNFSVLYHDEYDVRLAPVYDVLDTSIYRVGTQGIFDAYDDTLALNLTNHGKKTYPSKNTLLDFAEKYCDLGREDASFMIDTIVQAKEQVLVKYSDVLRENEWLAQKWHFIPDENEEGLPFTFR

SEQ ID NO: 1817 - protein, 145 aa, Neisseria
MSRYLITFDMDTNCLKDNYHGNNYTNAYSDIKTILARHGFENIQGSVYLGREGISEAHGTIAIQELTARFDWFYSCISNIKFYRLESDLNAQFIADGVYQAKQAFLQRVEQLRISLTEAGLSDEQINQVLEKQKFELESPNLKLN

SEQ ID NO: 1818 - protein, 186 aa, Neisseria
MTANFAQTLVEIQDSLYRVVSTVQYGDDNLKRLTADKRKQYELNFKISEGSTRVESDFKETLVRFGRDMLQDMPPKIRSATLVALTTLLVGGALGYGYLEYLKQVASEGYQTERLYNAVDRLAESQERITSAILKGARGADFVQIGRRSYSREDISEANRRAERVPYGAELVSDGNFTAVLSDIGD

SEQ ID NO: 1819 - protein, 186 aa, Neisseria
  VARIANT (1)...(186): Xaa = Any Amino Acid
MTANFAQTLVEIQDSLXRVVSTVQYGDDNLKRLTADKRKQYELNFKISEGSTRVESDFKETLVRFGRDMLQDMPPKIRSATLVALTTLLVGGALGYGYLEYLKQVASEGYQTERLYNAVDRLAESQERITSAILKGARGADFVQIGRRSYSREDISEANRRAERVPYGAELVSDGNFTAVLSDIGD

SEQ ID NO: 1820 - protein, 187 aa, Neisseria
MKILALLIAATCALSACGSQSEEQPASAQPQEQAQSELKTMPVSYTDYQSAANKGLNDQKTGLTLPEHVVPIDNAEGKNLLHDFSDGLTILTVDTDKADKITAVRVVWNTDAMPQKAEKLSKAAAALIAATAPEDRTMLRDTGDQIEMAIDSHNAQKEPTREWARGGIAYKVTVTNLPSVVLTAKAE

SEQ ID NO: 1821 - protein, 167 aa, Neisseria
MNNLTVFTRFDTDLATLADELQYVWEHTAVTDHQGKLVEIPVCYGGEYGPDLAEVAAFHQTVISEIVRRHTAQTYTVFMMGFQPGFPYLGGLPEALHTPRRAVPRTSVPAGSVGIGGSQTGVYPFASPGGWQIIGRTELPLFRADLNPPTLLAAGDQVRFVAERIEP

SEQ ID NO: 1822 - protein, 167 aa, Neisseria; identical to SEQ ID NO: 1821

SEQ ID NO: 1823 - protein, 1431 aa, Neisseria
MRFTHTTPFCSVLSTLGLFAVSPAYSSIVRNDVDYQYFRDFAENKGAFTVGASNISIQDKQGKILGRVLNGIPMPDFRVSNRQTAIATLVHPQYVNSVKHNVGYGSIQFGNDTQNPEEQAYTYRLVSRNPHPDYDYHLPRLNKLVTEISPTALSSVPLLGNGQPKANAYLDTDRFPYFVRLGSGTQQVRKADGTRTRTAPAYQYLTGGTPLKVLGFQNHGLLVGGSLTDQPLNTYAIAGDSGSPLFAFDKHENRWVLAGVLSTYAGFDNFFNKYIVTQPEFIRSTIRQYETRLDVGLTTNELIWRDNGNGNSTLQGLNERITLPIANPSLAPQNDSRHMPSEDAGKTLILSSRFDNKTLMLADNINQGAGALQFDSNFTVVGKNHTWQGAGVIVADGKRVFWQVSNPKGDRLSKLGAGTLIANGQGINQGDISIGEGTVVLAQKAASDGSKQAFNQVGITSGRGTAVLADSQQIKPENLYFGFRGGRLDLNGNNLAFTHIRHADGGAQIVNHNPDQAATLTLTGNPVLSPEHVEWVQWGNRPQGNAAVYEYINPHRNRRTDYFILKPGGNPREFFPLNMKNSTSWQFIGNNRQQAAEQVAQAENARPDLITFGGYLGENAQTGKAAPSYSKTNEAAIEKTRHIANAAVYGRPEYRYNGALNLHYRPKRTDSTLLLNGGMNLNGEVLIEGGNMIVSGRPVPHAYDHQAKREPVLENEWTDGSFKAARFTLRNHARLTAGRNTAHLDGDITAYDLSGIDLGFTQGKTPECYRSYHSGSTHCTPNAVLKAENYRALPATQVRGDITLNDRSELRLGKAHLYGSIRAGKDTAVRMEADSNWTLSQSSHTGALTLDGAQITLNPDFANNTHNNRFNTLTVNGTLDGFGTFRFLTGIVRKQNAPPLKLEGDSRGAFQIHVKNTGQEPQTTESLALVSLNPKHSHQARFTLQNGYADLGAYRYILRKNNNGYSLYNPLKEAELQIEATRAEHERNQQAYNQLQATDISRQVQHDSDATRQALQAWQNSQTELARIDSQVQYLSAQLKQTDPLTGILTRAQNLCAAQGYSADICRQVAKAADTNDLTLFETELDTYIERVEMAESELDKARQGGDAQAVETARHAYLNALNRLSRQIHSLKTGVAGIRMPNLAELISRSANTAVSEQAAYNTGRQQAGRRIDRHLTDPQQQNIWLETGTQQTDYHSGTHRPYQQTTNYAHIGIQTGITDRLSVGTILTDERTNNRFDEGVSARNRSNGAHLFVKGENGALFAAADLGYSNSRTRFTDYDGAAVRRHAWDAGINTGIKIDTGINLRPYAGIRINRSNGNRYVLDGAEINSPAQIQTTWHAGIRLDKTVELGQAKLTPAFSSDYYHTRQNSGSALSVNDRTLLQQAAHGTLHTLQIDAGYKGWNAKLHAAYGKDSNTARHKQAGIKIGYNW

SEQ ID NO: 1824 - protein, 154 aa, Neisseria
NNRNTRYAALGKRVMEGVETEISGAITPKWQIHAGYSYLHSQIKTAANPRDDGIFLLVPKHSANLWTTYQVTPGLTVGGGVNAMSGITSSAGMHAGGYATFDAMAAYRFTPKLKLQINADNIFNRHYYARVGGTNTFNIPGSERSLTANLRYSF

SEQ ID NO: 1825 - protein, 708 aa, Neisseria
MGQFMSVFRINMTAATVLAALSSSVFAAQTEGLETVHIKGQRSYNAIATEKNGDYSSFAATVGTKIPASLREIPQSVSIITNQQVKDRNVDTFDQLARKTPGLRVLSNDDGRSSVYARGYEYSEYNIDGLPAQMQSINGTLPNLFAFDRVEVMRGPSGLFDSSGEMGGIVNLVRKRPTKAFQGHAAAGFGTHKQYKAEADVSGSLNSDGSVRGRVMAQTVGASPRPAEKNNRRETFYAAADWDINPDTVLGAGYLYQQRRLAPYNGLPADANNKLPSLPQHVFVGADWNKFKMHSHDVFADLKHYFGNGGYGKVGMRYSDRKADSNYTFAGSKLNNTGQADVAGLGTDIKQKAFAVDASYSRPFALGNTANEFVIGADYNRLRSTNEQGRSTLSKSVALDGFRALPYNGILQNARAGNKGFNHSVTEENLDETGLYAKTVFRPLEGLSLIAGGRVGHHKIESGDGKTLHKASKTKFTSYAGAVYDIDGSNSLYASASQLYTPQTSIGTDGKLLKPREGNQFEIGYKGSYMDDRLNTRVSFYRMKDKNAAAPLDSNNKKTRYAALGKRVMEGVETEISGAMTPKWQIHAGYSYLHSQIKTASNSRDEGIFLLMPKHSANLWTTYQVTSGLTIGGGVNAMSGITSSAGIHAGGYATFDAMAAYRFTPKLKLQINADNIFNRHYYARVGSESTFNIPGSERSLTANLRYSF

SEQ ID NO: 1826 - protein, 703 aa, Neisseria
MKISFHLALLPTLIIASFPVAAADTQDNGEHYTATLPTVSVVGQSDTSVLKGYINYDEAAVTRNGQLIKETPQTIDTLNIQKNKNYGTNDLSSILEGNAGIDAAYDMRGESIFLRGFQADASDIYRDGVRESGQVRRSTANIERVEILKGPSSVLYGRTNGGGVINMVSKYANFKQSRNIGAVYGSWANRSLNMDINEVLNKNVAIRLTGEVGRANSFRSGIDSKNVMVSPSITVKLDNGLKWTGQYTYDNVERTPDRSPTKSVYDRFGLPYRMGFAHRNDFVKDKLQVWRSDLEYAFNDKWRAQWQLAHRTAAQDFDHFYAGSENGNLIKRNYAWQQTDNKTLSSNLTLNGDYTIGRFENHLTVGMDYSREHRNPTLGFSSAFSASINPYDRASWPASGRLQPILTQNRHKADSYGIFVQNIFSATPDLKFVLGGRYDKYTFNSENKLTGSSRQYSGHSFSPNIGAVWNINPVHTLYASYNKGFAPYGGRGGYLSIDTLSSAVFNADPEYTRQYETGVKSSWLDDRLSTTLSAYQIERFNIRYRPDPKNNPYIYAVSGKHRSRGVELSAIGQIIPKKLYLRGSLGVMQAKVVEDKENPDRVGIHLNNTSNVTGNLFFRYTPTENLYGEIGVTGTGKRYGYNSRNKEVTTLPGFARVDAMLGWNHKNVNVTFAAANLLNQKYWRSDSMPGNPRGYTARVNYRF

SEQ ID NO: 1827 - protein, 703 aa, Neisseria
MKISFHLALLPTLIIASFPVAAADTQDNGEHYTATLPTVSVVGQSDTSVLKGYINYDEAAVTRNGQLIKETPQTIDTLNIQKNKNYGTNDLSSILEGNAGIDAAYDMRGESIFLRGFQADASDIYRDGVRESGQVRRSTANIERVEILKGPSSVLYGRTNGGGVINMVSKYANFKQSRNIGTVYGSWANRSLNMDINEVLNKNVAIRLTGEVGRANSFRSGIDSKNVMVSPSITVKLDNGLKWTGQYTYDNVERTPDRSPTKSVYDRFGLPYRMGFAHRNDFVKDKLQVWRSDLEYAFNDKWRAQWQLAHRTAAQDFDHFYAGSENGNLIKRNYAWQQTDNKTLSSNLTLNGDYTIGRFENHLTVGMDYSREHRNPTLGFSSAFSASINPYDRASWPASGRLQPILTQNRHKADSYGIFVQNIFSATPDLKFVLGGRYDKYTFNSENKLTGSSRQYSGHSFSPNIGAVWNINPVHTLYASYNKGFAPYGGRGGYLSIDTLSSAVFNADPEYTRQYETGVKSSWLDDRLSTTLSAYQIERFNIRYRPDPKNNPYIYAVSGKHRSRGVELSAIGQIIPKKLYLRGSLGVMQAKVVEDKENPDRVGIHLNNTSNVTGNLFFRYTPTENLYGEIGVTGTGKRYGYDSRNKEVTTLPGFARVDAMLGWNHKNVNVTFAAANLFNQKYWRSDSMPGNPRGYTARVNYRF

SEQ ID NO: 1828 - protein, 147 aa, Neisseria
MKWLLNMIMRPIKFSMVNTLLFIVICSSFFDLLVQLCTILFHSQKIYFITLFLLFIFNFVTKSIYMAIIYPILYFFTIKKYYPYSRKVIILLSLALSIYFSFMDFYFFSIYSDNLSYETEPLHLYIPIIINFFSLLVSNFILSFINK

SEQ ID NO: 1829 - protein, 147 aa, Neisseria; identical to SEQ ID NO: 1828

SEQ ID NO: 1830 - protein, 467 aa, Neisseria
MTLLNLMIMQDYGISVCLTLTPYLQHELFSAMKSYFSKYILPVSLFTLPLSLSPSVSAFTLPEAWRAAQQHSADFQASHYQRDAVRARQQQAKAAFLPHVSANASYQRQPPSISSTRETQGWSVQVGQTLFDAAKFAQYRQSRFDTQAAEQRFDAAREELLLKVAESYFNVLLSRDTVAAHAAEKEAYAQQVRQAQALFNKGAATALDIHEAKAGYDNALAQEIAVLAEKQTYENQLNDYTDLDSKQIEAIDTANLLARYLPKLERYSLDEWQRIALSNNHEYRMQQLALQSSGQALRAAQNSRYPTVSAHVGYQNNLYTSSAQNNDYHYRGKGMSVGVQLNLPLYTGGELSGKIHEAEAQYGAAEAQLTATERHIKLAVRQAYTESGAARYQIMAQERVLESSRLKLKSTETGQQYGIRNRLEVIRARQEVAQAEQKLAQARYKFMLAYLRLVKESGLGLETVFAE

SEQ ID NO: 1831 - protein, 467 aa, Neisseria
MTLLNLMIMQDYGISVCLTLTPYLQHELFSAMKSYFSKYILPVSLFTLPLSLSPSVSAFTLPEAWRAAQQHSADFQASHYQRDAVRARQQQAKAAFLPHVSANASYQRQPPSISSTRETQGWSVQVGQTLFDAAKFAQYRQSRFDTQAAEQRFDAAREELLLKVAESYFNVLLSRDTVAAHAAEKEAYAQQVRQAQALFNKGAATALDIHEAKAGYDNALAQEIAVLAEKQTYENQLNDYTGLDSKQIEAIDTANLLARYLPKLERYSLDEWQRIALSNNHEYRMQQLALQSSGQALRAAQNSRYPTVSAHVGYQNNLYTSSAQNNDYHYRGKGMSVGVQLNLPLYTGGELSGKIHEAEAQYGAAEAQLTATERHIKLAVRQAYTESGAARYQIMAQERVLESSRLKLKSTETGQQYGIRNRLEVIRARQEVAQAEQKLAQARYKFMLAYLRLVKESGLGLETVFAE

SEQ ID NO: 1832 - protein, 475 aa, Neisseria
MFFSALKSFLSRYITVWRNVWAVRDQLKPPKRTAEEQAFLPAHLELTDTPVSAAPKWAARFIMAFALLALLWSWFGKIDIVAAASGKTVSGGRSKTIQPLETAVVKAVHVRDGQHVKQGETLAELEAVGTDSDVVQSEQALQAAQLSKLRYEAVLAALESRTVPHIDMAQARSLGLSDADVQSAQVLAQHQYQAWAAQDAQLQSALRGHQAELQSAKAQEQKLVSVGAIEQQKTADYRRLRADNFISEHAFLEQQSKSVSNWNDLESTRGQMRQIQAAIAQAEQNRVLNTQNLKRDTLDALRQANEQIDQYRGQTDKAKQRQQLMTIQSPADGTVQELATYTVGGVVQAAQKMMVIAPDDDKMDVEVLVLNKDIGFVEQGQDAVVKIESFPYTRYGYLTGKVKSVSHDAVSHEQLGLVYTAVVSLDKHTLNIDGKAVNLTAGMNVTAEIKTGKRRVLDYLLSPLQTKLDESFRER

SEQ ID NO: 1833 - protein, 435 aa, Neisseria
MFFSALKSFLSRYITVWRNVWAVRDQLEPPKRTAEEQAFLPAHLELTDTPVSAAPKWAARFIMAFALLALLWSWFGKIDIVAAASGKTVSGGRSKTIQPLETVVVKAVHVRDGQHVKQGETLAELEAVGTDSDVVQSEQALQAAQLSKLRYEAVLAALESRTVPHIDMAQARSLGLSDADVQSAQVLAQHQYQAWAAQDAQLQSALRGHQAELQSAKAQEQKLVSVGAIEQQKTADYRRLRADNFISEHAFLEQQSKSVSNWNDLESTRGQMRQIQAAIAQAEQNRVLNTQNLKRDTLDALRQANEQIDQYRGQTDKAKQRQQLMTIQSPADGTVQELATYTVGGVVQAAQKMMVVAPDDDKMDVEVLVLNKDIGFVEQGQDAVVKIESFPYTRYGYLTGKVKSVSHDAVSHEQLGLVYTAVVSLDKHTLNIDGK

SEQ ID NO: 1834 - protein, 309 aa, Neisseria
MLRCRPKSVLDSDGIFLKFNFLRSKPKYEISFLPSFKRILCLSAVISVLGACAVVADVYGHDSATMNAAAAKDYMKTVELNKSAGNVDTTSRTARRVQAVFRRMLPYADAANNTSHKFDWKMTVFKNDELNAWAMPGGKMAFYTGIVDKLKLTDDEIAAIMGHEMTHALHEHGKNKVGQQILTNTAAQIGTQIILDKKPDTNPELVGLGMDILGTYGLTLPYSRSLEEEADEGGMMLMAQAGYHPAAAVRVWEKMNQENDQNGFIYAITSTHPTNNARIENLKRLLPTVMPVYEQSVRNKGRVNKKRRR

SEQ ID NO: 1835 - protein, 309 aa, Neisseria
MLRCRPKSVLDSDGIFLKFNFLRSKPKYEISFLPSFKRILCLSAVISVLGACTVVADVYGQDSATMNAAAAEDYMKTVELNKSAGNVDTTSKTARRVQAVFRRMLPYADAANNTGHKFDWKMTVFKNDELNAWAMPGGKMAFYTGIVDKLKLTDGEIAAIMGHEMTHALHEHGKNKVGQKILTNMAAQIGTQIILDKKPDTNPELVGLGMDILGMYGITLPYSRSLEEEADEGGMMLMAQAGYHPAAAVRVWEKMNQENDQNGFIYAITSTHPTNNARIENLKRLLPTVMPVYEHSVRNKGRVNKNRRR

SEQ ID NO: 1836 - protein, 214 aa, Neisseria
MKFKHLLPLLLSAVLSAQAYALTEGEDYLVLDKPIPQEQPGKIEVLEFFGYFCVHCHHFDPLLLKLGKALPSDTYLRTEHVVWRPEMLGLARMAAAVKLSGLKYQANSAVFKAVYEQKIRLENRAVAGKWALSQKGFDGKKLMRAYDSPEAAAVALKMQKLTEQYGIDSTPTVIVGGKYRVIFNNGFDGGVHTIKELVAKVREERKRQTPAVQK

SEQ ID NO: 1837 - protein, 214 aa, Neisseria
MKLKHLLPLLLSAVLSAQAYALTEGEDYLVLDKPIPQEQSGKIEVLEFFGYFCVHCHHFDPLLLKLGKALPSDAYLRTEHVVWQPEMLGLARMAAAVNLSGLKYQANPAVFKAVYEQKIRLENRSVAGKWALSQKGFDGKKLMRAYDSPEAAAAALKMQKLTEQYRIDSTPTVIVGGKYRVIFNNGFDGGVHTIKELVAKVREERKRQTPAVQK

SEQ ID NO: 1838 - protein, 214 aa, Neisseria
MKLKHLLPLLLSAVLSAQAYALTEGEDYLVLDKPIPQKQSGKIEVLEFFGYFCVHCHHFDPLLLKLGKALPSDAYLRTEHVVWQPEMLGLARMAAAVKLSGLKYQANPAVFKAVYEQKIRLENRSVAEKWALSQKGFDGKKLMRAYDSPAAAAAASKMQQLTEQYRIDSTPTVVVGGKYRVIFNNGFDGGVHTIKELVAKVREERKRQTPAVQK

SEQ ID NO: 1839 - protein, 119 aa, Neisseria
MNIKQLITAALIASAAFATQAAPQKPVSAAQTAQHSAVWIDVRSEQEFSEGHLHNAVNIPVDQIVRRIYEAAPDKDTPVNLYCRSGRRAEAALQELKKAGYTNVANHGGYEDLLKKGMK

SEQ ID NO: 1840 - protein, 119 aa, Neisseria
MNIKHLITAALIASAAFAAQAAPQKPVSAAQTAQHPAVWIDVRSEQEFSEGHLHNAVNIPVDQIVRRIHEAAPDKDTPVNLYCRSGRRAEAALQELKKAGYTNVANHGGYEDLLKKGMK

SEQ ID NO: 1841 - protein, 119 aa, Neisseria
MNIKHLITAALIASAAFAAQAAPQKPVSAAQTAQHSAVWIDVRSEQEFSEGHLHNAVNIPVDQIVRRIHEAAPDKDTPVNLYCRSGRRAEAALQELKKAGYTNVANHGGYEDLLKKGMK

SEQ ID NO: 1842 - protein, 491 aa, Neisseria
LIMVIFYFYFCGKTFMPARNRWMLLPLLASAAYAEETPCEPDLRSRPEFRLHEAEVKPIDREKVPGQVREKGKVLQVDGETLLKNPELLSRAMYSAVVSNNIAGIRVILPIYLQQARQDKMLALYAQGILAQAEGRVKEAVSHYRELIAAQPDAPAVRMRLAAALFEDRQNEAAADQFDRLKTEDLPPQLMEQVELYRKALRERDAWKVNGGFSVTREHNINQAPKQQQYGNWTFPKQVDGTAVNYRFGAEKKWSLKNGWYTTAGGDVSGRVYPGNKKFNDMTAGVSGGIGFADRRKDVGLAVFHERRTYGNDAYSYANGARLYFNRWQTPRWQTLSSAEWGRLKNTRRARSDNTHLQISNSLVFYRNARQYWTGGLDFYRERNPADRGDNFNRYGLRFAWGQEWGGSGLSSLFRLGVAKRHYEKPGFFSSFKGERRRDKESDTSLSLWHRALHFKGITPRLTLSHRETWSNDVFNEYEKNRAFVEFNKTF

SEQ ID NO: 1843 - protein, 490 aa, Neisseria
LIMVIFYFCGKTFMPARNRWMLLLPLLASAAYAEETPREPDLRSRPEFRLHEAEVKPIDREKVPGQVREKGKVLQIDGETLLKNPELLSRAMYSAVVSNNIAGIRVILPIYLQQAQQDKMLALYAQGILAQADGRVKEAISHYRELIAAQPDAPAVRMRLAAALFENRQNEAAADQFDRLKAENLPPQLMEQVELYRKALRERDAWKVNGGFSVTREHNINQAPKRQQYGKWTFPKQVDGTAVNYRLGAEKKWSLKNGWYTTAGGDVSGRVYPGNKKFNDMTAGVSGGIGFADRRKDAGLAVFHERRTYGNDAYSYTNGARLYFNRWQTPKWQTLSSAEWGRLKNTRRARSDNTHLQISNSLVFYRNARQYWMGGLDFYRERNPADRGDNFNRYGLRFAWGQEWGGSGLSSLLRLGAAKRHYEKPGFFSGFKGERRRDKELNTSLSLWHRALHFKGITPRLTLSHRETRSNDVFNEYEKNRAFVEFNKTF

SEQ ID NO: 1844 - protein, 490 aa, Neisseria
LIMVIFYFCGKTFMPARNRWMLLLPLLASAAYAEETPREPDLRSRPEFRLHEAEVKPIDREKVPGQVREKGKVLQIDGETLLKNPELLSRAMYSAVVSNNIAGIRVILPIYLQQAQQDKMLALYAQGILAQADGRVKEAISHYRELIVAQPDAPAVRMRLAAALFENRQNEAAADQFDRLKAENLPPQLMEQVELYRKALRERDAWKVNGGFSVTREHNINQAPKRQQYGKWTFPKQVDGTAVNYRLGAEKKWSLKNGWYTTAGGDVSGRVYPGNKKFNDMTAGVSGGIGFADRRKDAGLAVFHERRTYGNDAYSYTNGARLYFNRWQTPKWQTLSSAEWGRLKNTRRARSDNTHLQISNSLVFYRNARQYWMGGLDFYRERNPADRGDNFNRYGLRFAWGQEWGGSGLSSLLRLGAAKRHYEKPGFFSGFKGERRRDKELNTSLSLWHRALHFKGITPRLTLSHRETRSNDVFNEYEKNRAFVEFNKTF

SEQ ID NO: 1845 - protein, 186 aa, Neisseria
MNRLLLLSAAVLPTACGSGETDKIGRASTVFNMLGKNDRIEVEGFDDPDVQGVACYISYAKKGGLKEMVNLEEDASDASVSCVQTASSISFDETAVRKPKEVFKRGTGFAFKSRQIVRYYDPKRKAFAYLVYSDKIVQGSPKNSLSAVSCFGSGIPQTDGVQADTSGKLLAGACIISNPIKNPDKR

SEQ ID NO: 1846 - protein, 186 aa, Neisseria
MNRLLLLSAAVLLTACGSGETDKIGRASTVFNILGKNDRIEVEGFDDPDVQGVACYISYAKKGGLKEMVNLEEDASDASVSCVQTASSISFDETAVRKPKEVFKHGASFAFKSRQIVRYYDPKRKTFAYLVYSDKIIQGSPKNSLSAVSCFGGGIPQTDGVQADTSGNLLAGACMISNPIENLDKR

SEQ ID NO: 1847 - protein, 186 aa, Neisseria
MNRLLLLSAAVLLTACGSGETDKIGRASTVFNILGKNDRIEVEGFDDPDVQGVACYISYAKKGGLKEMVNLEEDASDASVSCVQTASSISFDETAVRKPKEVFKHGASFAFKSRQIVRYYDPKRKTFAYLVYSDKIIQGSPKNSLSAVSCFGGGIPQTDGVQADTSGNLLAGACMISNPIENPDKR

SEQ ID NO: 1848 - protein, 700 aa, Neisseria
MDLLSVFHKYRLKYAVAVLTMLLLAAVGLHASVYRTFTPENIRSRLQQSIAHTHRKISFDADIRRRLLPRPTVILKNLTITEPDGGRVAVSVKETKIGLSWKNLWSDRIQVEKWVVSGADLALTRDRNGAWNIQDLFDGAKHSASVNRIIVENSTVRLNFLQQQLILKEISLNLQSPDSSGQQFESSGILVWRKLSVPWKSRGLFLSDGIGTPEISPFHFEASTSLDGHGITISTTGSPSVRFNAGGADAAGLGLRADTSFRNLHLTAQIPALALKNNSIKTGTVNGTFTAGGEYARWDGSFKLDKANLHSGIANIGNAEISGSFKTPRLQTNFSLGSPLVWSRDNGLDAPRLHISTLQDTVDRLPQPRFISRLDGSLSIPNLQNWNAELNGTFDRQPVAAKFKYTREGAPHLEAAAALQKLNLAPYLDEFRQQNGKIFPDILGRLSGNVEAHLKIGSIQLPGLQLDDMETYLHADKDHIALSRFKSGLYGGHTEGGISIANTRPATYRLQQNASNIQIQPLLQDLFGFHSFSGNGDAVIDLTASGENRKQLIRSLQGSLSLNISNGAWHGIDMDSILKNGLSGKISGSTPFYRFTLNSEISDGISRHIDTELFSDSLYVTSNGYTNLDTQELSEDVLIRNAVHPKNKPIPLKITGTVDKPSITVDYGRLTGGINSRKEKQKILEDTLLEQWQWLKPKEP

SEQ ID NO: 1849 - protein, 704 aa, Neisseria
MDLLSVFHKYRLKYAVAVLTILLLAAVGLHASVYRTFTPENIRSRLQQSIAHTHRKISFDADIQRRLLPRPTVILKNLTITEPGGDQTAVSVQETKIGLSWKNLWSDQIQIEKWVVSSAELALTRDGKGVWNIQDLIDSQKRQASVNRIIVENSTVRLNFLQEQLILKEINLNLQSPDSSGQPFESSGILVWGKLSVPWKSRGLFLSNGIGPPEISPFHFEASTSLDGHGITISTTGSPSVRFNAGGADAAGLGLRADTSFRNLHLTAQIPALALRNNSIKIETVNGAFTAGGEYARWDGSFKLDKANLHSGIANIGNAEISGSFKTPRHQTNFSLNSPLVWTENKGLDAPRLYVSTLQDTVNRLPQPRFISRLDGSLSVPNLQNWNAELNGTFDRQTVAAKFRYTHEDAPHLEAAVALQKLNLTPYLDDVRQQNGKIFPDTLAKLSGDIEAHLKIGKVQLPGLQLDDMETYLHADKGHIALSRFKSGLYGGHTEGGISIANTRPATYRLQQNASNIQIQPLLQDLFGFHSFSGNGDAVIDLTAGGETRKELIRSLQGSLSLNISNGAWHGIDMDNILKNGISGKTADNAAPSTPFHRFTLNSEISDGISRHIDTELFSDSLYVTSNGYTNLDTQELSEDVLIRNAVHPKNKPIPLKITGTVDKPSITVDYGRLTGGINSRKEKQKILEDTLLEQWQWLKPKEP

SEQ ID NO: 1850 - protein, 704 aa, Neisseria
MDLLSVFHKYRLKYAVAVLTILLLAAIGLHASVYRIFTPENIRSRLQQSIAHTHRKISFDADIQRRLLPRPTVILKNLTITEPGGDRTAVSVQETKIGLSWKNLWSDQIQIEKWVVSSAELALTRDGKGVWNIQDLIDSQKRQASVNRIIVENSTVRLNFLQEQLILKEINLNLQSPDSSGQPFESSGILVWGKLSVPWKSRGLFLSDGIGTPKISPFHFEASTSLDGHGITISTTGSPSVRFNAGGADAAGLGLRADTSFRNLHLTAQIPTLALRNNSIKIETVNGAFTAGGEYAQWDGSFKLDKANLHSGIANIGNAEISGSFKTPRHQTNFSLNSPLVWTENKGLDAPRLYVSTLQDTVNRLPQPRFISRLDGSLSVPNLQNWNAELNGTFDRQTVAAKFRYTHEDAPHLEAAVALQKLNLTPYLDDVRQQNGKIFPDTLAKLSGDIEAHLKIGKVQLPGLQLDDMETYLHADKGHIALSRFKSGLYGGHTEGGISIANTRPATYRLQQNASNIQIQPLLQDLFGFHSFSGNGDAVIDLTAGGETRKELIRSLQGSLSLNISNGAWHGIDMDNILKNGISGKTADNAAPSTPFHRFTLNSEISDGISRHIDTELFSDSLYVTSNGYTNLDTQELSEDVLIRNAVHPKNKPIPLKITGTVDKPSITVDYGRLTGGINSRKEKQKILEDTLLEQWQWLKPKEP

SEQ ID NO: 1851 - protein, 297 aa, Neisseria
VFGTVLRTDADCLQIIVVGKFFQVVAYGFAALAEGEFHQFGEMIEIVRLADTVFHRNHAHHCGIDFRRGIERFGRHVNQQLHIEKILQHHTQATVVVAFRRGNHALDHFFLQHKVHIGDIVRHLRQFEQKRRGDVIRQVADDFLFADAVEIKLQHVAFVNHQFIRKRQRFQTAYDVAVDFDNVQAVQLFRQRFGNCRQTRADFNHDIIRLRAHGVDNIADNPRVLQKILPETLAGFVFFHRVSSSVETPPFRAAGSDSVWAGRNPFQIRTTHRAVLYVSSCVLEHKCVYSIRLMSAL

SEQ ID NO: 1852 - protein, 298 aa, Neisseria
MFGAVLRIDADCLQIIVACKLFQIVAYGFAALVEGEFHEFGKMLEIVRLADAVFHRNHTDDGGIHFRRRVERFGRYVNQHFHIEKILQHHAQAAVVVAFRRGNHTLDHFFLQHKVHIDDIVRHLRQLEQKRCGNVVREVADDFLFACDAVEIKLQYIAFVNHQFIRKRQRFQTAYDVAVDFDNVQAVQLFRQRFGNRRQTRADFNHDIIRLRAHGVDNIADNPRVLQKILPETLAGFVFFHRVSFSVETPPFRAVESDSIWEGRNSFQIRMAHRAVLYVSSCVLKHKCVYSIRLMSAL

SEQ ID NO: 1853 - protein, 298 aa, Neisseria
MFGAVLRIDADCLQIIVACKLFQIVAYGFAALVEGEFHEFGEMLEIVRLADTVFHRNHADDGRIHFRRGVERFGRHVNQHFHIEEILQHHAQAAVVVAFRRGNHTIDHFFLQHKVHIDDIVRHLRQLEQKRRGNVVGQVADDFLFACDAVEIKLQYIAFVNHQFIRKRQRFQTAYDVAVDFDNVQAVQLFRQRFGNRRQTRTDFNHDIIRLRAHGVDNIADNPRVLQKILPETLAGFVFFHRVSFSVETPPFRAVESDSIWEGRNSFQIRTAHRAVLYVSSCVLKHKCVYSIRLMSAL

SEQ ID NO: 1854 - protein, 260 aa, Neisseria
MGLGATTFVGSGAIGGGLCSTGIGCAAGGLIATAGMTGGYTQASEGSRQLFGTYQSDFGKKVVLSLGTPIEYESPLVSDAKNLAVWGLETLITRKLGNLATGVKTSLTPKTADVQRNILSQSEVGIKWGKGIEGQGMPWEDYVGKGLSANARLPKNFKTFDYFDRGTGTAISAKTLDTQTTARLSKPEQLYSTMKGYIDKTANFKSYELSEVPLRADMIKQREIHLAIPAQTNKEQRLQLQRVVEYGKSQNITVKITEIE

SEQ ID NO: 1855 - protein, 237 aa, Neisseria
MKTKLPLFIIWLSVSASCASVLPVPEGSRTEMPTQENASDGIPYPVPTLQDRLDYLEGKIVRLSNEVEMLNGKVKALEHTKIHPSGRTYVQKLDDRKLKEHYLNTEGGSASAHTVETAQNLYNQALKHYQNGRFSAAAALLKGADGGDGGSIAQRSMYLLLQSRARMGNCESVIEIGGRYANRFKDSPTAPEVIFKIGECQYRLQQKDIARATWRSLIQTYPGSPAAKRAAAAVRKR

SEQ ID NO: 1856 - protein, 237 aa, Neisseria
MKIKLPLFIIWLSVSASCASVSPVPAGSQTEMSTRENASDGIPYPVPTLQDRLDYLEGKIVRLSNEVETLNGKVKALEHAKTHSSGRAYVQKLDDRKLKEHYLNTEGGSASAHTVETAQNLYNQALKHYKSGKFSAAASLLKGADGGDGGSIAQRSMYLLLQSRARMGNCESVIEIGGRYANRFKDSPTAPEAMFKIGECQYRLQQKDIARATWRSLIQTYPGSPAAKRAAAAVRKR

SEQ ID NO: 1857 - protein, 238 aa, Neisseria
MKTKLPLFIIWLSVSAACSSPVSRNIQDMRLEPQAEAGSSDAIPYPVPTLQDRLDYLEGTLVRLSNEVETLNGKVKALEHAKTHPSSRAYVQKLDDRKLKEHYLNTEGGSASAHTVETAQNLYNQALKHYKSGRFSAAASLLKGADGGDGGSIAQRSMYLLLQSRARMGNCESVIEIGGRYANRFKDSPTAPEAMFKIGECQYRLQQKDIARATWRSLIQTYPGSPAAKRAAAAVRKR

SEQ ID NO: 1858 - protein, 342 aa, Neisseria
MARRSKTFEEAAAEVEERFGHRGIKLVEFEGTAKPCVINCPKHGNQTCSRYSNMFIGSSWGCPSCGNEQAAKAGIATLRKNHIALEMLKQAVTGMTKQERITTQAYNEMTKSVAGSNSIVLNDVQGDTTINNHHTHTHNHSDADGKALSMRLTPRPLLSDRQAAAFARTGKLTGSFDLFASVVAPSQYTFAVAMPDTSMSPVIEKGDLLVVEPRMCPADEDIALIELSDKRLVVAHLVIDIAGRMLIYQTGRPSEAFDLPEGSTILGVVLESKNGLCPPHRQEGVLIRITAPDVWTVGMISASKTSCTRPTAARKSAVCFLRFWQATRGIPKTRSWRNPNNA

SEQ ID NO: 1859 - protein, 343 aa, Neisseria
MARRSKTFEEAAAEVEERFGHRGIKLVEFEGTAKPCVINCPKHGNQTCSRYSNMFIGSSWGCPSCGNEQAAKAGIATLRKNHIALEMLKQAVTGMTKQERITTQAYNEMTKSVAGSNSIILNDVQGDTTINNHHTHTHNHSDADGKALSMRLTPRPLLSDRQAAAFARTGKLTGSFDLFASVVAPSQYTFAVAMPDTSMSPVIEKGDLLVVEPRMRPADEDIVLIELSDKRLVVAHLVIDIAGRMLIYQTGRPSEALDLPEGSVILGVVLESKNGLCPPHRQEGVLIRITAPDVWTVGTISASKTSCTRPTAARKSAVCFLRFWQATRGIPKTRSWRNPNNAC

SEQ ID NO: 1860 - protein, 800 aa, Neisseria
MVNYYSAMIKKILTTCFGLFFGFCVFGVGLVAIAILVTYPKLPSLDSLQHYQPKMPLTIYSADGEVIGMYGEQRREFTKIGDFPEVLRNAVIAAEDKRFYRHWGVDVWGVARAAVGNVVSGSVQSGASTITQQVAKNFYLSSEKTFTRKFNEVLLAYKIEQSLSKDKILELYFNQIYLGQRAYGFASAAQIYFNKNVRDLTLAEAAMLAGLPKAPSAYNPIVNPERAKLRQKYILNNMLEEKMITVQQRDQALNEELHYERFVRKIDQSALYVAEMVRRELYEKYGEDAYTQGFKVYTTVRTDHQKAATEALRKALRNFDRGSSYRGAENYIDLSKSEDVEETVSQYLSGLYTVDKMVPAVVLDVTKKKNVVIQLPGGRRVALDRRALGFAARAVDNEKMGEDRIRRGAVIRVKNNGGRWAVVQEPLLQGALVSLDAKTGAVRALVGGYDFHSKTFNRAVQAMRQPGSTFKPFVYSAALSKGMTASTVVNDAPISLPGKGPNGSVWTPKNSDGRYSGYITLRQALTASKNMVSIRILMSIGVGYAQQYIRRFGFRPSELPASLSMALGTGETTPLKVAEAYSVFANGGYRVSSHVIDKIYDRDGRLRAQMQPLVAGQNAPQAIDPRNAYIMYKIMQDVVRVGTARGAAALGRTDIAGKTGTTNDNKDAWFVGFNPDVVTAVYIGFDKPKSMGRAGYGGTIAVPVWVDYMRFALKGKQGKGMKMPEGVVSSNGEYYMKERMVTDPGLMLDNSGIAPQPSRRAKEDDEAAVENEQQGRSDETRQDVQETPVLPSNTDSKQQQ

SEQ ID NO: 1861 - protein, 805 aa, Neisseria
MVNYYSAMIKKILTTCFGLVFGFCVFGVGLVAIAILVTYPKLPSLDSLQHYQPKMPLTIYSADGEVIGMYGEQRREFTKIGDFPEVLRNAVIAAEDKRFYRHWGVDVWGVARAAVGNVVSGSVQSGASTITQQVAKNFYLSSEKTFTRKFNEVLLAYKIEQSLSKDKILELYFNQIYLGQRAYGFASAAQIYFNKNVRDLTLAEAAMLAGLPKAPSAYNPIVNPERAKLRQKYILNNMLEEKMITVQQRDQALNEELHYERFVRKIDQSALYVAEMVRQELYEKYGEDAYTQGFKVYTTVRADHQKVATEALRKALRNFDRGSSYRGAENYIDLSKSEDVEETVSQYLSGLYTVDKMVPAVVLDVTKKKNVVIQLPGGRRVTLDRRALGFAARAVNNEKMGEDRIRRGAVIRVKNNGGRWAVVQEPLLQGALGSLDAKTGAVRALVGGYDFHSKTFNRAVQAMRQPGSTFKPFVYSAALSKGMTASTVVNDAPISLPGKGPNGSVWTPKNSDGRYSGYITLRQALTASKNMVSIRILMSIGVGYAQQYIRRFGFRSSELPASLSMALGTGETTPLKVAEAYSVFANGGYRVSSHVIDKIYDRDGRLRAQMQPLVAGQNAPQAIDPRNAYIMYKIMQDVVRVGTARGAAALGRTDIAGKTGTTNDNKDAWFVGFNPDVVTAVYIGFDKPKSMGRVGYGGTIAVPVWVDYMRFALKGKQGKGMKMPEGVVSSNGEYYMKERMVTDPGLTLDNSGIAPQPSRRAKEDDGGAAEGGRQAADDEVRQDMQETPVLPSNTGSKQQQLDSLF

SEQ ID NO: 1862 - protein, 805 aa, Neisseria
MVNYYSAMIKKILTTCFGLVFGFCVFGVGLVAIAILVTYPKLPSLDSLQHYQPKMPLTIYSADGEVIGMYGEQRREFTKIGDFPEVLRNAVIAAEDKRFYRHWGVDVWGVARAAVGNVVSGSVQSGASTITQQVAKNFYLSSEKTFTRKFNEVLLAYKIEQSLSKDKILELYFNQIYLGQRAYGFASAAQIYFNKNVRDLTLAEAAMLAGLPKAPSAYNPIVNPERAKLRQKYILNNMLEEKMITVQQRDQALNEELHYERFVRKIDQSALYVAEMVRQELYEKYGEDAYTQGFKVYTTVRADHQKVATEALRKALRNFDRGSSYRGAENYIDLSKSEDVEETVSQYLSGLYTVDKMVPAVVLDVTKKKNVVIQLPGGRRVTLDRRALGFAARAVNNEKMGEDRIRRGAVIRVKNNGGRWAVVQEPLLQGALVSLDAKTGAVRALVGGYDFHSKTFNRAVQAMRQPGSTFKPFVYSAALSKGMTASTVVNDAPISLPGKGPNGSVWTPKNSDGRYSGYITLRQALTASKNMVSIRILMSIGVGYAQQYIRRFGFRSSELPASLSMALGTGETTPLKVAEAYSVFANGGYRVSSHVIDKIYDRDGRLRAQMQPLVAGQNAPQAIDPRNAYIMYKIMQDVVRVGTARGAAALGRTDIAGKTGTTNDNKDAWFVGFNPDVVTAVYIGFDKPKSMGRVGYGGTIAVPVWVDYMRFALKGKQGKGMKMPEGVVSSNGEYYMKERMVTDPGLTLDNSGIAPQPSRRAKEDDGGAAEGGRQAADDEVRQDMQETPVLPSNTGSKQQQLDSLF

SEQ ID NO: 1863 - protein, 254 aa, Neisseria
MFRIVKWLIALPVGIFIFFNAYVYGNIITYRAVAPHRTAFMSMRMKQFEQEGRDVALDYRWVPYNRISTNLKKALIASEDVRFAGHGGFDGDGIQNAIRRNRNSGEVKAGGSTISQQLAKNLFLNESRNYLRKGEEAAITAMMEAVTDKNRIFELYLNSIEWHYGVFGAEAASRYFYKKPAADLTKQQAAKLTVLVPAPFYYSDHPKSKRLRNKTNIVLRRMGSANYPKAKRTDCSRYGNAATGVRTAYVFWDL

SEQ ID NO: 1864 - protein, 233 aa, Neisseria
MFRIIKWLIALPVGIFIFFNAYVYGNIITYRAVAPHRTAFMSMRMKQFEQEGRDVALDYRWMPYKRISTNLKKALIASEDARFAGHGGFDWGGIQNAIRRNRNSGKVKAGGSTISQQLAKNLFLNESRSYIRKGEEAAITAMMEAVTDKDRIFELYLNSIEWHYGVFGAEAASRYFYQIPAAKLTKQQAAKLTARVPAPLYYADHPKSKRLRNKTNIVLKRMGSAELPESDTD

SEQ ID NO: 1865 - protein, 233 aa, Neisseria
MFRIIKWLIALPVGIFIFFNAYVYGNIITYRAVAPHRTAFMSMRMKQFEQEGRDVALDYRWMPYKRISTNLKKALIASEDARFAGHGGFDWGGIQNAIRRNRNSGKVKAGGSTISQQLAKNLFLNESRSYIRKGEEAAITAMMEAVTDKDRIFELYLNSIEWHYGVFGAEAASRYFYQIPAAKLTKQQAAKLTARVPAPLYYADHPKSKRLRNKTNIVLRRMGSAELPESDTD

SEQ ID NO: 1866 - protein, 582 aa, Neisseria
MLIKSEYKPRMLPKEEQVKKPMTSNGRISFVLMAMAVLFACLIARGLYLQTVTYNFLKEQGDNRIVRTQALPATRGTVSDRNGAVLALSAPTESLFAVPKDMKEMPSAAQLERLSELVDVPVDVLRNKLEQKGKSFIWIKRQLDPKVAEEVKALGLENFVFEKELKRHYPMGNLFAHVIGFTDIDGKGQEGLELSLEDSLYGEDGAEVVLRDRQGNIVDSLDSPRNKAPQNGKDIILSLDQRIQTLAYEELNKAVEYHQAKAGTVVVLDARTGEILALANTPAYDPNRPGRADSEQRRNRAVTDMIEPGSAIKPFVIAKALDAGKTDLNERLNTQPYKIGPSPVRDDTHVYPSLDVRGIMQKSSNVGTSKLSARFGAEEMYDFYHELGIGVRMHSGFPGETAGLLRNWRRWRPIEQATMSFGYGLQLSLLQLARAYTALTHDGVLLPLSFEKQAVAPQGKRIFKESTAREVRNLMVSVTEPGGTGTAGAVDGFDVGAKTGTARKFVNGRYADNKHVATFIGFAPAKNPRVIVAVTIDEPTAHGYYGGVVAGPPFKKIMGGSLNILGISPTKPLTAAAVKTPS

SEQ ID NO: 1867 - protein, 581 aa, Neisseria
MLIKSEYKPRMLPKEEQVKKPMTSNGRISFVLMAIAVLFAGLIARGLYLQTVTYNFLKEQGDNRIVRTQTLPATRGTVSDRNGAVLALSAPTESLFAVPKEMKEMPSAAQLERLSELVDVPVDVLRNKLEQKGKSFIWIKRQLDPKVAEEVKALGLENFVFEKELKRHYPMGNLFAHVIGFTDIDGKGQEGLELSLEDSLHGEDGAEVVLRDRQGNIVDSLDSPRNKAPKNGKDIILSLDQRIQTLAYEELNKAVEYHQAKAGTVVVLDARTGEILALANTPAYDPNRPGRADSEQRRNRAVTDMIEPGSAIKPFVIAKALDAGKTDLNERLNTQPYKIGPSPVRDTHVYPSLDVRGIMQKSSNVGTSKLSARFGAEEMYDFYHELGIGVRMHSGFPGETAGLLRNWRRWRPIEQATMSFGYGLQLSLLQLARAYTALTHDGVLLPVSFEKQAVAPQGKRIFKESTAREVRNLMVSVTEPGGTGTAGAVDGFDVGAKTGTARKFVNGRYADNKHIATFIGFAPAKNPRVIVAVTIDEPTAHGYYGGVVAGPPFKKIMGGSLNILGISPTKPLTAAAVKTPS

SEQ ID NO: 1868 - protein, 581 aa, Neisseria; identical to SEQ ID NO: 1867

SEQ ID NO: 1869 - protein, 515 aa, Neisseria
VRFNHFIMVTIIIYVISPANKPVRRPGVPTYPALPYNCFFYVTDSPMNFPKTAASLLLLLASLAAHALDTGRIPQNEIAVYVQELDSGKVIIDHRAGIPVNPASTMKLVTAFAAFKTFGSNYRWATEFKSNGTVNDGTLDGNLYWAGSGDPVFNQENLLAVQRQLRDKGIRNITGRLMLDHSLWGEVGSPDHFEADSGSPFMTPPNPTMLSAGMVMVRAERNAAGSTDILTDPPLPHIFAQNNLKITASQAACPSVKKLMRASFSGNTLKLRGNIPESCLGKPVGVRMFALDELIRQSFTNRWLLGGGRISDGIGIADTPEGAQTLAVAHSKPMKEILTDMNKRSDNLIARSVFLKLGGDGKLPAVSEQAASAVRRELAVSGIDVADLVLENGSGLSRKERVTARMMAQMLETAYFSPFAQDFIDTLPIAGTDGTLRNRFKQSGGLLRLKTGTLNNVRALAGYWLGDKPMAVVVIINSGRAVSLLPDLDNFVAKNIISGGDGWLDAKLMCKERRA

SEQ ID NO: 1870 - protein, 515 aa, Neisseria
VRLNHFIMIAIIIYVISPANKPARRHSVPTYPALPYNCFFYVTDLPMNFPKTAASLLLLLASLAAHALDTGRIPQNEIAVYVQELDSGKVIIDHRSDVPVNPASTMKLVTAFAAFKTFGSNYRWATEFKSNGTVNDGTLDGNLYWAGSGDPVFNQENLLDAQKQLREQGILNITGHLMLDHSLWGEVGSPDDFEADSGSPFMTPPNPTMLSAGMVMVRAERNAAGSTDILTDPPLPHIFAQNNLKITASQAACPSIKKLMRASFSDNTLKLRGNIPESCLGKPVGVRMFALDELIRQSFTNHWLLGGGRISDGIGIADTPEGAQTLAVAHAKPMKEILTDMNKRSDNLIARSVFLKLGGDGKLPAVSEQAASAVRRELAVSGIDVADLVLENGSGLSRKERVTARMMAQMLETAYFSPFAQDFIDTLPIAGTDGTLRNRFKQSGGLLRLKTGTLNNVRALAGYWLGDKPMAVVVIINSGRAVSLLPDLDNFVANNIISGGDGWLDAKLMCKERRA

SEQ ID NO: 1871 - protein, 515 aa, Neisseria
VRLNHFIMIAIIIYVISPANKPARRHSVPTYPALPYNCFFYVTDLPMNFPKTAASLLLLLASLAAHALDTGRIPQNEIAVYVQELDSGKVIIDHRSDVPVNPASTMKLVTAFAAFKTFGSNYRWATEFKSNGTVNDGTLDGNLYWAGSGDPVFNQENLLAVQRQLREQGIRNITGHLMLDHSLWGEVGSPDDFEADSGSPFMTPPNPTMLSAGMVMVRAERNAADSTDILTDPPLPHIFAQNNLKITASQAACPSIKKLMRASFSDNTLKLRGNIPESCLGKPVGVRMFALDELIRQSFTNHWLLGGGRISDGIGISDTPEGAQTLAVAHSKPMKEILTDMNKRSDNLIARSVFLKLGGDGKLPAVSEQAASAVRRELAVSGIDVADLVLENGSGLSRKERVTARMMAQMLETAYFSPFAQDFIDTLPIAGTDGTLRNRFKQSGGLLRLKTGTLNNVRALAGYWLGDKPMAVVVIINSGRAVSLLPDLDNFVANNIISGGDGWLDAKLMCKERRA

SEQ ID NO: 1872 - protein, 390 aa, Neisseria
MPSEMPSETWQAEVRTALGLFQRADADRIAYFIQQFARFFARFLRACLQNLFDLRRIRGQCVVAFAQFCQFGVDFRRRKFFRLAPSQAVGKHLRKFRRFRRRGEGFIDFKQRAFVGLFRLARLFHVGNDFVDRFLGFFVVFPKRNGIAVGFGHFASVQTDQEFDVFVDFHFGQGEEFLETVGEAAGNVARHFDVLDLVAPDGDFVGVEHQNVGSHQNRITEQTHFHTEIGVFLPVFRIGLNGGFVGVGAVHQTLGGDAGQNPVQLHHFGNVALAVEGGALGVESAGKPSGGNGLGGLVNHLLLVAFDDAVVIGEEEEGFGIGVLRRADGGADGADVVAQMRGAGGGYAGQNSFFAHKNVLTAAMPSEREKDAPIIPDLPHTSSRQQTFPY

SEQ ID NO: 1873 - protein, 385 aa, Neisseria
  VARIANT (1)...(385): Xaa = Any Amino Acid
MPSETRQAEVRTASGSFQRADADRIXYFVQFACFFTRFRRACLQNLFDLRRVGGQLVVAFARFGEFGVDFRRQKFFGFTPRQAVGKHFRKFHRFRRRGEGFVDFKQWAFVGLFRLARLFHIGDDFVDRFLGFFVVFPKRNGVAVGFGHFASVQTDQEFDVFIDFHFGQGEEFPEAVVEAAGDVARHFDVLDLVAPDGHFVGVEHQNIGSHQNRITEQTHFHTEIRVFLPVFCICLHGGFVGMGAVHQTLGSDAGQNPVQFHHFGSVALAVEGGALGVESAGKPSGGNGLGGLVNHLRLVAFDDTVVIGEEEEGFGIEVLRRADGGADGADVVAQMRDAGGGYAGQNSFFAHKNVLAASMPSEREKDVPIIPDLPPTSSRQQTFPY

SEQ ID NO: 1874 - protein, 377 aa, Neisseria
EVRTALGLFQRADTDRITYFAQFACFFTRFLRACLQNLFDLRRVGGQLVVAFARFGEFGVDFRRQKFFCLAPSQAVGKHFRKFCRFRRRGESFVDFKQRAFVGLLRLARLFHIGDDFVDRFLGFFVVFPKRNGVAVGFGHFASVQTNQEFDVFVDFHFGQCEEFPEAVVEAAGNIACHFNVLDLVATDWNFMGIEHENVGSHEDRVAVQTHFHAEIGVFLPVFRICLHGGFVGVGAVHQTLGGDAGQNPVQFHHFGNVALTVEGGALGVESAGKPSGGNGLGGLVNHLRLVAFDDTVVIGEEEEGFGIRVLRRADGGADSTDVVAQMRDAGGGYAGQNSFFAHKNVLAASMPSEREKDAPIIPDLPPTSSRQQTFPY

SEQ ID NO: 1875 - protein, 269 aa, Neisseria
  VARIANT (1)...(269): Xaa = Any Amino Acid
MPDFSMSNLAVAFSITLAAGLFTVLXSGLVMFSKTPNPRVLSFGLAFAGGAMVYVSLTEIFSKSSEAFAEIYDKDHAFAAATMAFLAGMGGIALIDRLVPNPHETLDAQDPSFQESKRRHIARVGMMAAFAITAHNFPEGLATFFATLENPAVGMPLALAIAIHNIPEGISIAAPVYFATRSRKKTVWACLLSGLAEPLGAALGYLVLQPFLSPAVFGSVFGVIAGVMVFLALDELXPAAKRYSDGHETVYGLTTGMAVIAVSLVLFHF

SEQ ID NO: 1876 - protein, 269 aa, Neisseria
MPDFSMSNLAVAFSITLAAGLFTVLGSGLVMFSKTPNPRVLSFGLAFAGGAMVYVSLTEIFSKSSEAFAEIYDKDHAFAAATMAFLAGMGGIALIDRLVPNPHETLDAQDPSFQESKRRHIARVGMMAAFAITAHNFPEGLATFFATLENPAVGMPLALAIAIHNIPEGISIAAPVYFATRSRKKTVWACLLSGLAEPLGAALGYLVLQPFLSPAVFGSVFGVIAGVMVFLALDELLPAAKRYSDGHETVYGLTMGMAVIAVSLVLFHF

SEQ ID NO: 1877 - protein, 361 aa, Neisseria
MPSEPERRHGNTALPFPIAARPTVGFSGKPFKITGKCVVLRRRIVQAVDFTPRLFAVGHFADVPAYVFACDAHTDGLTIKRVHGADVVQNGGSAFCQTQGRRNAVFGIMLQIAEKPRPALRAAPYHDAVGGGLFEDGGGFLRRSDVAVDPGRDVQTAFGLGDEFVTRLAFVHLRARAPVNGKGGNAAIFGDFGDGGQVLIVVVPTQTGFEGNGYARRLDHRLQNGGNQRLVLHQRATGLDVAHFLGGAAHIDVDDLRPESDVVTRRIRHLFGVAAGNLHGNDAAFIGKITAVQGFSGIPERRIAGQHFAHRPTCAKRPTEAAEGFVGNARHRRKCDGVVDKITADVHNGPAFQKSAPLYIF

SEQ ID NO: 1878 - protein, 360 aa, Neisseria
LHFQRIIKCSEGIWAVGARPTVGFFGKSFKITCKHVVLRRRTVQAVDFTTCLFAVGHFVDVPAYVFACDAHTGGVAVKRVYGADVVQNSGGAFCQTQGRRQNTVFGIMFQIAEEPRPALRAAPYHNAVGGGLFEDGLGFLRRSNVAVDPDRDVQTAFGFGDEFVTRFAFVHLRTRASVDGKGGDAAIFGDFGDDGQVLMVVVPTQTGFEGNGYACRTDDGFQNGGNQRLVLHQRATGLDIADFFSGTAHVDVDKLRPKADVVTRGIRHLLRIASGNLHGNNAAFIGKIAAVQGFSSISERRVAGQHFAHRPTCAKISAKSAERFVGNARHRRKCDGVVDKIAADVHNGSAFQKSTPLYIF

SEQ ID NO: 1879 - protein, 359 aa, Neisseria
LHFQRIIKCSEGIWAVGARPTVGFFGKSFKITCKHVVLRRRTVQAVDFTTCLFAVGHFVDVPAYVFACDAHTGGVAVKRVHGSDVVQNSGGTFCQTQGRRNTVFGVMFQIAEEPRSALRAAPYHNAVCGGLFEDGLGFLRRGNVAVDPDRDVQTAFGFGNQVVSRFAFVHLRARASVDGKGGNAAIFGDFGDDGQVLMVVVPTQTGFEGNGYARRFDHRLQNGGNQRLVLHQRATGLDIADFFSGTAHVDVDKLRPKADVVTRGIRHLLRIASGNLHGNNAAFIGKIAAVQGFSSISERRVAGQHFAHRPTCAKISAKSAERFVGNARHRRKCDGVVDKIAADVHNGSAFQKSTPLYIF

SEQ ID NO: 1880 - protein, 525 aa, Neisseria
  VARIANT (1)...(525): Xaa = Any Amino Acid
MATQVGGANSDEASPCFPISEVELVGEETAKFRFALNHALCQTHFVSGKCLHAGDINQIMSLAQNALIGRGYTTTRILAAPQDLNSGKLQLTLMPGYLRSIRIDRSNDDQTHAGRIAAFQNKFPTRSNDLLNLRDLEQGLENLKCLPTAEADLQIVPVEREPNQSDVVVQWRXRLLPYCVSVGMDNSGSEATGKYQGNITFSADNPFGLSDMFYVNYGRSIGGTPDEENFDGHRKEGGSNNYAVHYSAPFGKWTWAFNHNGYRYHQAVSGLSEVYDYNGKSYNTDFGFNRLLYRDAKRKTYLSVKLWTRETKSYIDDAELTVQRRKTTGWLAELSHKGYIGRSTADFKLKYKHGTGMKDALRAPEEAFGEGTSRMKIWTASADVNTPFQIGKQLFAYDTSVHAQWNKTPLTSQDKLAIGGHHTVRGFDGEMSLPAERGWYWRNDLSWQFKPGHQLYLGADVGHVSGQSAKWLSGQTLAGTAIGIRGQIKLGGNLHYDIFTGRALKKPEYFQTKKWVTGFQVGYSF

SEQ ID NO: 1881 - protein, 547 aa, Neisseria
  VARIANT (1)...(547): Xaa = Any Amino Acid
MQRQQHIDAELLTDANVRFEQPLEKNNYVLSEDETPCTRVNYISLDDKTVRKFSFLPSVLMKETAFKTGMCLGSNNLSRLQKAAQQILIVRGYLTSQAIIQPQNMDSGILKLRVSAGEIGDIRYEEKRDGKSAEGSISAFNNKFPLYRNKILNLRDVEQGLENLRRLPSVKTDIQIIPSEEEGKSDLQIKWQQNKPIRFSIGIDDAGGKTTGKYQGNVALSFDNPLGLSDLFYVSYGRGLAHKTDLTDATGTETESGSRSYSVHYSVPVKKWLFSFNHNGHRYHEATEGYSVNYDYNGKQYQSSLAAERMLWRNRLHKTSVGMKLWTRQTYKYIDDAEIEVQRRRSAGWEAELRHRAYLNRWQLDGKLSYKRGTGMRQSMPAPEENGGDILPGTSRMKIITASLDAAAPFXLGKQQFFYATAIQAQWNKTPLVAQDKLSIGSRYTVRGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 1882 - protein, 547 aa, Neisseria
  VARIANT (1)...(547): Xaa = Any Amino Acid
MQRQQHIDAELLTDANVRFEQPLEKNNYVLSEDETPCTRVNYISLDDKTARKFSFLPSVLMKETAFKTGMCLGSNNLSRLQKAAQQILIVRGYLTSQAIIQPQNMDSGILKLRVSAGEIGDIRYEEKRDGKSAEGSISAFNNKFPLYRNKILNLRDVEQGLENLRRLPSVKTDIQIIPSEEEGKSDLQIKWQQNKPIRFSIGIDDAGGKTTGKYQGNVALSFDNPLGLSDLFYVSYGRGLVHKTDLTDATGTETESGSRSYSVHYSVPVKKWLFSFNHNGHRYHEATEGYSVNYDYNGKQYQSSLAAERMLWRNRFHKTSVGMKLWTRQTYKYIDDAEIEVQRRRSAGWEAELRHRAYLNRWQLDGKLSYKRGTGMRQSMPAPEENGGGTIPGTSRMKIITAGLDAAAPFMLGKQQFFYATAIQAQWNKTPLVAQDKLSIGSRYTVXGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 1883 - protein, 436 aa, Neisseria
MMQHNRFFAVGAGGDDGDRRAADFFNPFQICFGIGRQCVVAFHADSRFAPAGHGFVNRFAGFHRIRTARQDVGFAAAWQFVADADIDGFNAVHYIEFGNAHTGNAVDLDGAFQGGGIKPAAAARAAGYRTEFVSALRQTCAYFVEQFGRERARTDARGIGFDDAQNIIQHLRTYARACRSRAGETVGRGNEGVSAVVDVQQRTLRAFKQQFFAVFVFFVQHAGHVGNHRRNARRDFFDNRHHVFRFNRSGVMQVLELDVVIGKDGIQFFTQFFRMQQIGGANGAACHFVFVGRADAAAGRADFAFAARCFAGLVERDVVRQDQRAGRRDFQTAFDVFHACRVQLVDFAQQGFGGNDNARTDEAIQSFVQDTARNQAQNGFFAADDQGMARIVAALEAHDAAGFFRQPVNDFTFTLVAPLCADYYNIFSHSHITYRY

SEQ ID NO: 1884 - protein, 436 aa, Neisseria
  VARIANT (1)...(436): Xaa = Any Amino Acid
MMQHNRFFSVGAGGDDGDRRAADFFNPFQICFGVFGQCAVVLHAESGFAPAGHGFVNRLAGFHRIGTARQDVGFAAVGQFIADADIDGFNAVHYIEFSNTHTGNAVDLDGAFQGGGIKPAAAACASGYRTEFVSAFCQTYAYFVEQFGRERARTDARGIGFDDAQNIIQHLRTYARACRSCARQTVGRGNEGISAVVDVQQRTLRAFKQQFFAVFVFLVQHAGHVGNHRRNARRDFFDNRHHVFRFNRLGIVQMLQLDIVIGKDGIQFFTQFXRMQQIGGANGAACHFVFVGRADAAAGRADFAFAAXIFAGLVERDVVRQDQRAGRRDFQTAFDVFHACRVQLVDFAQQGFGGDDNARTDEAVQTFMQDAARNQAQNGFFAADNQGMARIVAALEAHHAAGFFRQPVNDFTFTLVAPLCADXYNIFSHSHITYRY

SEQ ID NO: 1885 - protein, 435 aa, Neisseria
  VARIANT (1)...(435): Xaa = Any Amino Acid
MMQHNRFFAVGAGGDDGDRRTADFFNPFQICFGIGRCVVAFHAESGFAPTGHGFVNRLAGFYRIRAARQDVGFAAVGQFVADADIDGFNAVHYIEFGNTHTGNAVDLDGAFQGGGIKPAAAACASGYRTEFVSAFCQTCSDFVEQFGRERARTDARGIGFDDAQNIIQHLRAYARACRSRAGEAVGRSNEGVSAVVDVQQRTLRAFKQQFFAVFVFFVQHAGHVGNHRRNARRDFFDNRHHVFRFHRLGIVQMLQLDVVISKDGIQFFTQFFRMQQIGGANGAACHFVFVGRADAAAGRADFAFAARCFSGLVERDVIRQDQRAGRRDFQTAFDVFHACRVQLVDFAQQGFGGDDNARTDEAVQTFMQDAARNQAQNGFFAADNQGMTRIVAALEAHHASGFFRQPVNDFTFTLVAPLCADYYNIFSHSHITXRY

SEQ ID NO: 1886 - protein, 112 aa, Neisseria
MKYIVSISLAMGLAACSFGGFKPNPWDAASFWELKNYANPYPGSASAALDQYPSKARRRQLKDMQECGYDPIDGGKSEADACLRKKGWCRKGFDPYPENKKYEWPREEGKTK

SEQ ID NO: 1887 - protein, 126 aa, Neisseria
MKKPTDTLPVNLQRRRLLCAAGALLISPLAHAGAQREETLADDVASVMRSSVGSVNPPRLVFDNPKEGERWLSAMSARLARFVPDEGERRRLLVNIQYESSRAGLDTQIVLGLIEVESGYRARIIS

SEQ ID NO: 1888 - protein, 207 aa, Neisseria
  VARIANT (1)...(207): Xaa = Any Amino Acid
MRKPTDTLPVNLQRRRLLCAAGALLLSPLAHAGAQREETLADDVASVMRSSVGSVNPPRLVFDNPKEGERWLSAMSARLARFVPEEEERRRLLVNIQYESSRAGLDTQIVLGLIEVESAFRQYAISGVGARGLMQVMPXWKNYIGKPAHNLFDIRTNLRYGCTILRHYRNLEKGNIVRALARFNGSLGSNKYPNAVLGAWRNRWQWR

SEQ ID NO: 1889 - protein, 207 aa, Neisseria
MKKPTDTLPVNLQRRRLLCAAGALLLSPLAQAGAQREETLADDVASVMRSSVGSINPPRLVFDNPKEGERWLSAMSARLARFVPDEEERRRLLVNIQYESSRAGLDTQIVLGLIEVESAFRQYAISGVGARGLMQVMPFWKNYIGKPAHNLFDIRTNLRYGCTILRHYRNLEKGNIVRALARFNGSLGSNKYPNAVLGAWRNRWQWR

SEQ ID NO: 1890 - protein, 165 aa, Neisseria
  VARIANT (1)...(165): Xaa = Any Amino Acid
MXKSRLSRYKQNKLIGLFVAGVTARTAAELVGINKNTAAYDFHRLRLIYQNGPHLEMFDGEVEADESYFGGQRKGKRGRGAAGKVAVFGLLKRNGKVYTVTVPNTQTATLFPIIREQVKPDSIVYTDCYRSYDVLDVSEFSHFSFAETSFSYQSQHTFCRTTKPY

SEQ ID NO: 1891 - protein, 166 aa, Neisseria
  VARIANT (1)...(166): Xaa = Any Amino Acid
MRKSRLSQYKQXKLIELFVTGVTARTAAELVGVNKNTAAYYFHRLRLLIYQNSPHLEMFDGEVEADESYFGGQRKGKRGRGAAGKVAVFGLLKRNGKVYTVTVPNTQTATLFPIIREQVKPDSIFYTDCYRSYDVLDVREFSHFSFAETSFSYQSQHTFCRTTKPY

SEQ ID NO: 1892 - protein, 166 aa, Neisseria
MRKSRLSQYKQNKLIELFVAGVTARTAAELVGVNKNTAAYYFHRLRLLIYQNSPHLEMFDGEVEADESYFGGQRKGKRGRGAAGKVAVFGLLKRNGKVYTVTVPNTQTATLFPIIREQVKPDSIVYTDCYRSYDVLDVREFSHFSFAETSFSYQSQHTFCRTTKPY

SEQ ID NO: 1893 - protein, 109 aa, Neisseria
MRKTVLILTISAALLSGCTWETYQDGSGKTAVRAKCSTGTPLCWQDGRGSKKVDCDEYGGERRAVLRNQKRGKPATRRAATLGKPSFRARDGGGRVNRAETGEGKRSAR

SEQ ID NO: 1894 - protein, 90 aa, Neisseria
MRKTFLFLTAAAALLSGCAWETYQDGNGKTAVRQKYPAGTPVYYQDGSYSKNMNYNQYRPERHAVLPNQTGNNADEEHRQHWQKPKFQNR

SEQ ID NO: 1895 - protein, 90 aa, Neisseria
MRKTFLILMTAAALLSGCAWETYQDGNGKTAVRQKYPAGTPVYYQDGSYSKNMNYNQYRPERHAVLPNQTGNNADEEHRQHWQKPKFQNR

SEQ ID NO: 1896 - protein, 94 aa, Neisseria
MKKLLLAAVVSLNAATAFAGDSAERQIYGDPHFEQNRTKAVKMLEQRGYQVYDVDADDYWGKPVLEVEAYKDGREYDIVLSYPDLKIIKEQLDR

SEQ ID NO: 1897 - protein, 94 aa, Neisseria
MKKLLLAAVVSLSAAAAFAGDSAERQIYGDPHFEQNRTKAVKMLEQRGYQVYDVDADDHWGKPVLEVEAYKDGREYDIVLSYPDLKIIKEQLDR

SEQ ID NO: 1898 - protein, 94 aa, Neisseria
MKKLLLVAVVSLSAATAFAGDSAERQIYGDPYFEQNRTKAVKMLEQRGYQVHDVDADDHWGKPVLEVEAYKDGREYDIVLSYPDLKIIKEQLDR

SEQ ID NO: 1899 - protein, 164 aa, Neisseria
MKKNILEFWVGLFVLIGAAAVAFLAFRVAGGAAFGGSDKTYAVYADFGDIGGLKVNAPVKSAGVLVGRVGAIGLDPKSYQARVRLDLDGKYQFSSDVSAQILTSGLLGEQYIGLQQGGDTENLAAGDTISVTSSAMVLENLIGKFMTSFAEKNAEGGNAEKAAE

SEQ ID NO: 1900 - protein, 164 aa, Neisseria
MKKNILEFWVGLFVLIGAAAVAFLAFRVAGGAAFGGSDKTYAVYADFGDIGGLKVNAPVKSAGVLVGRVGAIGLDPKSYQARVRLDLDGKYQFSSDVSAQILTSGLLGEQYIGLQQGGDTENLAAGDTISVTSSAMVLENLIGKFMTSFAEKNADGGNAEKAAE

SEQ ID NO: 1901 - protein, 164 aa, Neisseria; identical to SEQ ID NO: 1900

SEQ ID NO: 1902 - protein, 196 aa, Neisseria; identical to SEQ ID NO: 207

SEQ ID NO: 1903 - protein, 196 aa, Neisseria; identical to SEQ ID NO: 205

SEQ ID NO: 1904 - protein, 196 aa, Neisseria; identical to SEQ ID NO: 206

SEQ ID NO: 1905 - protein, 277 aa, Neisseria
MKKTAYAILLLIGFASAPAFAETRPADPYEGYNRAVSKFNDQADRYIFAPAARGYRKVTPKPVRAGVSNFFNNLRDVVSFGSNILRLDIKRASEDLVRVGINTTFGLGGLIDIAGAGGVPDNKNTLGDTFASWGWKNSNYFVLPVLGPSTVRDALGTGITSVYPPKNIVFHTPAGRWGTTAAAAVSTREGLLDLTDSLDEAAIDKYSYTRDLYMKVRARQTGATPAEGTEDNIDIDIDELVESAETGAAEPAVHEDSVSETQAEAAGEAETQPGTQP

SEQ ID NO: 1906 - protein, 275 aa, Neisseria
MKKTAYAFLLLIGFASAPAFAETRPADPYEGYNRAVFKFNDQADRYIFAPAARGYRKVAPKPVRAGVSNFFNNLCDVVSFGSNILRLDIKRASEDLVRVGINTTFGLGGLIDIAGAGGIPDNKNTLGDTFASWGWKNSNYFVLPVLGPSTVRDALGTGITSVYSPKNIVFRTPVGRWGTTAVSAVSTREGLLDLTDSLDEAAIDKYSYTRDLYMKVRARQTGATPAEGTEDNIDIDELVESAETGAAETAVQEDSVSETQAEAAGEAETQPGTQP

SEQ ID NO: 1907 - protein, 279 aa, Neisseria
MKKTAYAFLLLIGFASAPAFAETRPADPYEGYNRAVFKFNDQADRYIFAPAARGYRKVAPKPVRAGVSNFFNNLCDVVSFGSNILRLDIKRASEDLVRVGINTTFGLGGLIDIAGAGGIPDNKNTLGDTFASWGWKNSNYFVLPVLGPSTVRDALGTGITSVYSPKNIVFRTPVGRWGTTAVSAVSTREGLLDLTDSLDEAAIDKYSYTRDLYMKVRARQTGATPAEGTEDNIDIDELVESAETGAAETAVQEDSVSETQAEAAGEAETQPGTQPGTQP

SEQ ID NO: 1908 - protein, 240 aa, Neisseria
MKKCILGILTACAAMPAFADRISDLEARLAQLEHRVAVLESGGNTVKIDLFGSNSTMYVCSVTPFQKTFEASDRNEGVARQKVRQACNRETSAMFCGDEAIRCRKFDCIGWTDKETDTELGFRLCFSLPDFPCIGFQTALECQSCSADSASTIFCTRGCRTTSSPVKVWKYSPATPCSFSRASFNPDLMFLGRSIWLVSPVMTAFAPKPMRVRNIFICSGVVFCASSRMMYAPLSVLPRI

SEQ ID NO: 1909 - protein, 244 aa, Neisseria
  VARIANT (1)...(244): Xaa = Any Amino Acid
MKKCILGILTACAAMPAFADRIGDLEARLAQLEHRVAVLESGGNTVKIDLFGSNSTMYVCSVTPFQKTFEASDRNEGVARQKVRQACNRETSAMFCEDEAIRCRKFDXCIGWTDKETDTDTELGFRICFSLPDFPCIGFQTALECQSCSADSXASTIFCTKGCRTTSSPVKVWKYSPSTLCSFSRASFNPDLMFLGRSIWLVSPVMTAFAPKPMRVRNIFICSGVVFCASSRMMYAPLSVLPRI

SEQ ID NO: 1910 - protein, 240 aa, Neisseria
MKKCILGILTACAAMPAFADRIGDLEARLAQLEHRVAVLESGSNTVKIDLFGSNSTMYVCSVTPFQKTFEASDRNEGVARQKVRQACNRETSAMFCEDEAIRCRKFDCIGWTDKETDTELGFRICFSLPDFPCIGFQTALECQSCSADSASTIFCTKGCRTTSSPVKVWKYSPSTPCSFSRASFNPDLMFLGRSIWLVSPVMTAFAPKPMRVRNIFICSGVVFCASSRMMYAPLSVLPRI

SEQ ID NO: 1911 - protein, 164 aa, Neisseria; identical to SEQ ID NO: 1515

SEQ ID NO: 1912 - protein, 164 aa, Neisseria
  VARIANT (1)...(164): Xaa = Any Amino Acid
MKKTLLAIVAVSALSXCRQAEEGPPPLPRQISDRSVGHYCSMNLTEHNGPKAQIFLNGKPDQPVWFSTIKQMFGYTKLPEEPKGIRVIYVTDMGNVTDWTNPNADTEWMDAKKAFYVIDSGFIGGMGAEDALPFGNKEQAEKFAKDKGGKVVGFDDMPDTYIFK

SEQ ID NO: 1913 - protein, 164 aa, Neisseria; identical to SEQ ID NO: 1516

SEQ ID NO: 1914 - protein, 376 aa, Neisseria
MVKHLPLAVLTALLLAACGGSDKPPAEKPAPAENQNVLKIYNWSEYVDPETVADFEKKNGIKVTYDVYDSDETLESKVLTGKSGYDIVAPSNAFVGRQIKAGAYQKIDKSMIPNYKHLNPEMMRLMDGVDPDHEYAVPFYWGTNTFAINTERVKKALGTDKLPDNQWDLVFNPEYTFKLKQCGISYLDSAAEIYPMVLNYLGKNPNSSNTEDIREATALLKKNRPNIKRFTSSGFIDDLARGDTCVTIGFGGDLNIAKRRAEEAGGKEKIRVMMPKEGVGIWVDSFVIPKDAKNVANAHKYINDFLDPEVSAKNGNFVTYAPSSKPARDLMEDEFKNDNTIFPSGEDLKNSFIMVPIRPAALKFMVRQWQDVKAGK

SEQ ID NO: 1915 - protein, 376 aa, Neisseria
MTKHLPLAVLTALLLAACGGSDKPPAEKPAPAENQNVLKIYNWSEYVDPETVADFEKKNGIKVTYDVYDSDETLESKVLTGKSGYDIVAPSNAFVGRQIKAGAYQKIDKSLIPNYKHLNPEMMRLMDGVDPGHEYAVPFYWGTNTFAINTERVKKALGTDKLPDNQWDLVFDPEYTSKLKQCGISYLDSAAEIYPMVLNYLGKNPNSSNTEDIREATALLKKNRPNIKRFTSSGFIDDLARGDTCVTIGFGGDLNIAKRRAEEAGGKEKIRVMMPKEGVGIWVDSFVIPKDAKNVANAHKYINDFLDPEVSAKNGNFVTYAPSSKPARELMEDEFKNDNTIFPTEEDLKNSFIMVPIQPAALKFMVRQWQDVKAGK

SEQ ID NO: 1916 - protein, 376 aa, Neisseria
MTKHLPLAVLTALLLAACGGSDKPPAEKPAPAENRNVLKIYNWSEYVDPETVADFEKKNGIKVTYDVYDSDETLESKVLTGKSGYDIVAPSNAFVGRQIKAGAYQKIDKSLIPNYKHLNPEMMRLMDGVDPGHEYAVPFYWGTNTFAINTERVKKALGTDKLPDNQWDLVFDPEYTSKLKQCGISYLDSAAEIYPMVLNYLGKNPNSSNTEDIREATALLKKNRPNIKRFTSSGFIDDLARGDTCVTIGFGGDLNIAKRRAEEAGGKEKIRVMMPKEGVGIWVDSFVIPKDAKNVANAHKYINDFLDPEVSAKNGNFVTYAPSSKPARELMEDEFKNDNTIFPTEEDLKNSFIMVPIQPAALKFMVRQWQDVKAGK

SEQ ID NO: 1917 - protein, 441 aa, Neisseria
MKKHLLRSALYGIAAAILAACQSRSIQTFPQPDTSVINGPDRPAGIPDPAGTTVAGGGAVYTVVPHLSMPHWAAQDFAKSLQSFRLGCANLKNRQGWQDVCAQAFQTPVHSFQAKRFFERYFTPWQVAGNGSLAGTVTGYYEPVLKGDGRRTERARFPIYGIPDDFISVPLPAGLRGGKNLVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSGNEGPVGALGTPLMGEYAGAIDRHYITLGAPLFVATAHPVTRKALNRLIMAQDTGSAIKGAVRVDYFWGYGDEAGELAGKQKTTGYVWQLLPNGMKPEYRP

SEQ ID NO: 1918 - protein, 441 aa, Neisseria
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 1919 - protein, 441 aa, Neisseria
MKKYLFRAALCGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSVQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMQQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 1920 - protein, 207 aa, Neisseria
  VARIANT (1)...(207): Xaa = Any Amino Acid
PMQLVTEKGKENMIQRGTYNYQYRSNRPVKDGSYLVTAEYQPTFRSKNKAGWKQAGIKEMPDASYCEQTRMFGKNIVNVGHESADTAIITKPVGQNLEIVPLDNPADIHVGXRFKVRVLFRGEPLPNATVTATFDGFDTSDRSKTHKTEAQAFSDTTDGEGEVDIIPLRQGFWKASVEYKADFPDQSLCRKQANYTTLTFQIAHSHH

SEQ ID NO: 1921 - protein, 268 aa, Neisseria
  VARIANT (1)...(268): Xaa = Any Amino Acid
MKKTLTLLSVSALFATSAHAHRVWVETAHTHGGEYLKADLGYGEFPELEPIAKDRLHIFSKPMQLVTEKGKENMIQRGTYNYQYRSNRPVKDGSYLVIAEYQPTFWSKXKAGWKQAGIKEMPDASYCEQTRMFGKNIVNVGHESADTAIITKPVGQNLEIVPLDNPANIHVGERFKVRVLFRGEPLPNATVTATFDGFDTSDRSKTHXXEAQAFSDSTDDKGEVDIIXLRQGFWKANVEHKTDFPDQSVCQKQANYSTLTFQIGHSHH

SEQ ID NO: 1922 - protein, 267 aa, Neisseria
KKTLTLLAVSALFAASAHAHRVWVETAHTHGGEYLKADLGYGEFPELEPIAKDRLHIFSKPMQLVTEKGKENMIQRGTYNYQYRSNRPVKDGSYLVIAEYQPTFWSKNKAGWKQAGIKQMPDASYCEQTRMFGKNIVNVGHESADTAIITKPVGQNLEIVPLDNPANIHVGERFKVRVLFRGEPLPNATVTATFDGFDTSDRSKTHKTEAQAFSDSTDDKGEVDIIPLRQGFWKANVEHKADFPDQSVCQKQANYSTLTFQIGHSHH

SEQ ID NO: 1923 - protein, 268 aa, Neisseria
MKKTLTLLAVSALFATSAHPHRVWVETAHTHGGEYLKADLGYGEFPELEPIAKDRLHIFSKPMQLVTEKGKENMIQRGTYNYQYRSNRPVKDGSYLVTAEYQPTFRSKNKAGWKQAGIKEMPDASYCEQTRMFGKNIVNVGHESADTAIITKPVGQNLEIVPLDNPANIHVGERFKVRVLFRGEPLPNATVTATFDGFDTSDRSKTHKTEAQAFSDTTDGKGEVDIIPLRQGFWKASVEYKADFPDQSLCQKQANYTTLTFQIGHSHH

SEQ ID NO: 1924 - protein, 268 aa, Neisseria
MKKTLTLLAVSALFATSAHAHRVWVETAHTHGGEYLKADLGYGEFPELEPIAKDRLHIFSKPMQLVTEKGKENMIQRGTYNYQYRSNRPVKDGSYLVIAEYQPTFWSKNKAGWKQAGIKEMPDASYCEQTRMFGKNIVNVGHESADTAIITKPVGQNLEIVPLDNPANIHVGERFKVRVLFRGEPLPNATVTATFDGFDTSDRSKTHKTEAQAFSDSTDDKGEVDIIPLRQGFWKANVEHKTDFPDQSVCQKQANYSTLTFQIGHSHH

SEQ ID NO: 1925 - protein, 267 aa, Neisseria; identical to SEQ ID NO: 1922

SEQ ID NO: 1926 - protein, 162 aa, Neisseria
MKKYLIPLSIAAVLSGCQSIYVPTLTEIPVNPINTVKTEAPAKGFRLAPSHWADVAKISDEATRLGYQVGIGKMTKVQAAQYLNNFRKRLVGRNAVDDSMYEIYLRSAVDSQRGEINTEQSKLYIENALRGWQQRWKNMDAKPDNPAFTNFLMEVMKMQPLK

SEQ ID NO: 1927 - protein, 162 aa, Neisseria
MKKYLIPLSIAAVLSGCQSIYVPTLTEIPVNPINTVKTEAPAKGFRLASSHWTDVAKISDEATRLGYQVGIGKMTKVQAAQYLNNFRKRLVGRNAVDDSMYEIYLRSAIDSQRGAINTEQSKLYIQNALRGWQQRWKNMDVKPNNPAFTNFLMEVMKMQPLK

SEQ ID NO: 1928 - protein, 162 aa, Neisseria
MKKYLIPLSIVAVLSGCQSIYVPTLTEIPVNPINTVKTEAPAKGFRLASSHWTDVAKISDEATRLGYQVGIGKMTKVQAAQYLNNFRKRLVGRNAVDDSMYEIYLRSAIDSQRGAINTEQSKLYIQNALRGWQQRWKNMDVKPNNPAFTNFLMEVMKMQPLK

SEQ ID NO: 1929 - protein, 363 aa, Neisseria
MEKRKILPLAICLAALSACTAMEARTPRANEAQAPRADEMKKESRPAFDAAAVPVSDSGFAANANVRRFVDDEVGKGDFSQAEWQDFFDKAAYKADIVKIMHRPSTSRPWYVFRTGNSGRAKFHGARRFYAENRAVIDDVAQKYGVPAELIVAIIGIETNYGKNTGSFRVADALATLGFDYPRRAGFFQKELVELLKLAKEEGGDVFAFKGSYAGAMGMPQFMPSSYRKWAVDYDGDGHRDIWGNVGDVAASVANYMKQHGWRTGGKMLVSATLAPGADVQAIIGEKTALTRTVADLKAYGIIPGETLADDEKAVLFKLETAPGVFEYYLGLNNFYTVWQYNHSRMYVTAVRDIANSLGGPGL

SEQ ID NO: 1930 - protein, 369 aa, Neisseria
MKKRKILPLAICLAALSACTAMEARPPRANEAQAPRAVEMKKESRPAFDAAAVFDAAAVPVSDSGFAANANVRRFVDDEVGKGDFSRAEWQDFFDKAAYKADIVKIMHRPSTSRPWYVFRTGNSGKAKFRGARRFYAENRALIDDVAQKYGVPAELIVAVIGIETNYGKNTGSFRVADALATLGFDYPRRAGFFQKELVELLKLAKEEGGDVFAFKGSYAGAMGMPQFMPSSYRKWAVDYDGDGHRDIWGNVGDVAASVANYMKQHGWRTGGKMLVSATLAPGADVQAIIGEKTALTRTVADLKAYGIIPGEELADDEKAVLFKLETAPGVFEYYLGLNNFYTVWQYNHSRMYVTAVRDIANSLGGPGL

SEQ ID NO: 1931 - protein, 369 aa, Neisseria
MKNRKILPLAICLAALSACTAMEARPPRANEAQAPRADEMKKESRPAFDAAAVFDAAAVPVSDSGFAANANVRRFVDDEVGKGDFSRAEWQDFFDKAAYKADIVKIMHRPSTSRPWYVFRTGNSGKAKFRGARRFYAENRALIDDVAQKYGVPAELIVAVIGIETNYGKNTGSFRVADALATLGFDYPRRAGFFQKELVELLKLAKEEGGDVFAFKGSYAGAMGMPQFMPSSYRKWAVDYDGDGHRDIWGNVGDVAASIANYMKQHGWRTGGKILVSATLAPGADVQAIIGEKTALTRTVADLKAYGIIPGEELADDEKAVLFKLETAPGVFEYYLGLNNFYTVWQYNHSRMYVTAVRDIANSLGGPGL

SEQ ID NO: 1932 - protein, 123 aa, Neisseria
MKRQAFFKPMACAAFLSAVSLRLPVLGACYAILSLYAFALYGIDKRRAVRGKRRIPEHRLLLPALFGGWTGAYLGSRMFRHKTAKKRFVVLFRLTVSGNVLATCILIDYFVPPELFVKLGQHL

SEQ ID NO: 1933 - protein, 157 aa, Neisseria
  VARIANT (1)...(157): Xaa = Any Amino Acid
MKRQAFFKLMACAAFLSAVSLRLPVLGACYAILSLYAFALYGIDKRCAIRGQRRIPEHRLLLPALLGGWVGAYFGSMTFKHKTAKKRFVVLFRLTVSGNVLATLILIYSGLNLNQYGVASPCRTICTVCGFVALSFLLIHYXYFVPPEFFVKLGQNT

SEQ ID NO: 1934 - protein, 174 aa, Neisseria
  VARIANT (1)...(174): Xaa = Any Amino Acid
MKRQAFFKLMACAAFLSAVSLRLPVLGACYAILSLYAFALYGIDKRRAVRGKRRIPEHRLLLPALFGGWAGAYLGSRIFRHKTAKKRFVVLFRLTVSGNVLATLILIYSGLNLNQYGVASPXAQRERFSKVLKHQVNRFRTICTVCGFVALSFLLIHYXYFVPPEFFVKLGQNT

SEQ ID NO: 1935 - protein, 171 aa, Neisseria
MKQMLLAVGVGAVLAGCGKDAGGYEGYWREKSDKKEGVIAVKKKGNYFLNKINVFTGKEESLLLSEKDGALSINTGIGEIPIKLSDDGKELYVERRRYVKTDAAMKDKIIAHQKKCGQTAQAYLDARNALPSNQTYQQRQAAIEQLKRRFEAEFDELEKEIKCNGKPTLLF

SEQ ID NO: 1936 - protein, 50 aa, Neisseria
MKQMLLAVGVVAVLAGCGKDAGGYEGYWREKSDKKEGMIAVKKEKGNYFL

SEQ ID NO: 1937 - protein, 171 aa, Neisseria
MKQMLLAVGVAAVLAGCGKDAGGYEGYWREKSDKKEGVIAVKKKGNYFLNKINVFTGKEESLLLSEKDGALSINTGIGEIPIKLSDDGKELYVERRRYVKTDAAMKDKIIAHQKKCGQTAQAYLDARNALPSNQTYQQRQAAIEQLKRRFEAEFDELEKEIKCNGKPTLLF

SEQ ID NO: 1938 - protein, 173 aa, Neisseria
MKQMLLAVGVVAVLAGCGKDAGGYEGYWREKSDKKEGMIAVKKEKGNYFLNKIHVVTGKEESLLLSEKDGALSINTGIGEIPIKLSDDGKELYVERRQYVKTDAAMKDKIIAHQKKCGQTAQAYRDARNALPSNQTYQQHLAAIEQLKRRFEAEFDELEKEIKCNGRSPALLL

SEQ ID NO: 1939 - protein, 122 aa, Neisseria
NKINVFTGKEESMLLSEKDGALSINTGIGEIPIKLSDDGKELYVERRQYVKTDAAMKDKIIAHQKKCGQTAQAYLDARNALPSNQTYQQHQAAIEQLKRRFEAEFDELEKEIKCNGKPTLLF

SEQ ID NO: 1940 - protein, 163 aa, Neisseria
MKHTVSASVILLLTACAQLPQNNENLWQPSEHISSFAAEGRLAVKAEGKGSYANFDWTYQPPVETININTPLGSTLGQLCQDRDGALAVDGKGNVYQAEGTEDLSRQLVGFKLPIQYLHIWAEGRRVAGAPYRIRSDGILEQYGWTIGQNCRQWGASPNVATE

SEQ ID NO: 1941 - protein, 193 aa, Neisseria
MKHTVSASVILLLTACAQLPQNNENLWQPSEHISSFAAEGRLAVKAEGKGSYANFDWTYQPPVETININTPLGSTLGQLCQDRDGALAVDGKGNVYQAESAEELSRQLVGFKLPIQYLHIWADGRRVAGAPYRILPDGILEQYGWTVGRTADSGGQVRTLQLNNGNLNIRLVFTEIGMPSETETPERCAARTR

SEQ ID NO: 1942 - protein, 241 aa, Neisseria
  VARIANT (1)...(241): Xaa = Any Amino Acid
MKTYAQALYTAALLTACSPAADSNHPSGQNAPANTESDGKNITLLNASYDVTRYFYKEYDHLFVGTYQSEHPGTSVSIQQSHGGFSKQALSVANGLQADVVTMNQSSDIDLLEKXGLVEKGWQQALPDHAAPYTSTMVFLVRKNNPKQIRDWNDLAKDGVNIVIAKTSGNGRYAFLGAYGYGLKANNGNEQEAQKLVASILKNTPVFENGGRXPPPPPSHNATSATYSSLLKTKPTTSAKN

SEQ ID NO: 1943 - protein, 242 aa, Neisseria
  VARIANT (1)...(242): Xaa = Any Amino Acid
MKTYAPALYTAALLTACSPAADSNHPSGQNAPANTESDGKNITLLNASYDVARDFYKEYNPLFIKTYQSEHPGTSVSIQQSHGGSSKQALSVANGLQADVVTMNQSSDIDLLEKKGLVEKGWQQALPDHAAPYTSTMVFLVRKNNPKQIRDWNDLAKDGVNIVIANPKTSGNGRYAFLGAYGYGLKTTNGNEQEAQKLVASILKNTPVFENGGRXPPPPSHNATSATYSSLLKTKPTTSAKN

SEQ ID NO: 1944 - protein, 242 aa, Neisseria
MKTYAPALYTAALLSACSPAADSNHPSGQNAPANTESDGKNITLLNASYDVARDFYKEYNPLFIKTYQSEHPGTSVSIQQSHGGSSKQALSVANGLQADVVTMNQSSDIDLLEKKGLVEKGWQQALPDHAAPYTSTMVFLVRKNNPKQIRDWNDLAKDGVNIVIANPKTSGNGRYAFLGAYGYGLKTTNGNEQEAQKLVASILKNTPVFENGGRAPPPPSHNATSATYSSLLKTKPTTSAKN

SEQ ID NO: 1945 - protein, 487 aa, Neisseria
MKLGFKPIPLAIAAVLCALVLALPVPDGVKPQAWTLLAMFVGVIAAIIGKVMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMAITATAPNPLIVNLIAENLGSSFRLSWGAWAWAMAVPGVIAFFVMPLILYFLYPPEIKETPNAVQFAKDRLSEMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFLAAAVSLNAPAMPTALMMAAASNIMMTLTHYATGTSPVIFGSGYTTMGEWWKAGFIMSVVNFLIFSVIGSIWWKVLGYW

SEQ ID NO: 1946 - protein, 487 aa, Neisseria
  VARIANT (1)...(487): Xaa = Any Amino Acid
MKLGFKPIPLAIAAVLCALVLALPVPDGVKPQAWTLLAMFVGVIAAIIGKAMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYXLYPPEIKETPNAVQFAKDRLREMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFFAAAVSLNAPAMPTALMMAAASNIMMTLTHYATGTSPVIFGSGYTTMGEWWKAGFIMSVVNFLIFFVIGSIWWKVLGYW

SEQ ID NO: 1947 - protein, 487 aa, Neisseria
MKLGFKPIPLAIAAVLCALVLALPVPDGVKPQAWTLLAMFIGVIAAIIGKAMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYFLYPPEIKETPNAVQFAKDRLREMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFFAAAVSLNAPAMPTALMMAAASNIMMTLTHYATGTSPVIFGSGYTTMGEWWKAGFIMSVVNFLIFFVIGSIWWKVLGYW

SEQ ID NO: 1948 - protein, 160 aa, Neisseria
MKLPLSYLPNIRFLSWCCLLAGIIAPATLLASPNPAEIRMQQDIQQRQREEQLRQTMQPESDVRLHQKNTGETVNQLMGDDSSQPCFAINEWVLEGEHHARFQFALKRALRETGFQAGKCLHAGNINQIMSLAQNALIGRGYTTTRILAAPQDLNSGSFN

SEQ ID NO: 1949 - protein, 477 aa, Neisseria
GKCLHAGDINQIMSLAQNALIGRGYTTTRILAAPQDLNSGKLQLTLMPGYLRSIRIDRSNDDQTHAGRIAAFQNKFPTRSNDLLNLRDLEQGLENLKCLPTAEADLQIVPVEREPNQSDVVVQWRRLLPYCVSVGMDNSGSEATGKYQGNITFSADNPFGLSDMFYVNYGRSIGGTPDEENFDGHRKEGGSNNYAVHYSAPFGKWTWAFNHNGYRYHQAVSGLSEVYDYNGKSYNTDFGFNRLLYRDAKRKTYLSVKLWTRETKSYIDDAELTVQRRKTTGWLAELSHKGYIGRSTADFKLKYKHGTGMKDALRAPEEAFGEGTSRMKIWTASADVNTPFQIGKQLFAYDTSVHAQWNKTPLTSQDKLAIGGHHTVRGFDGEMSLPAERGWYWRNDLSWQFKPGHQLYLGADVGHVSGQSAKWLSGQTLAGTAIGIRGQIKLGGNLHYDIFTGRALKKPEYFQTKKWVTGFQVGYSF

SEQ ID NO: 1950 - protein, 595 aa, Neisseria
MKLPLSYLPNIRFLSWCCLLAGIIAPATLLASPNPAEIRMQQDIQQRQREEQLRQTMQPESDVRLHQKNTGETVNQLMGDDSSQPCFAINEVVLEGEHHARFQFALKRALRETGFQAGKCLHAGNINQIMSLAQNALIGRGYTTTRILAAPQDLNSGKLQLTLIPSYLRSIRIDRSNDDQTHAGRIAAFQNKFPTRSNDLLNLRDLEQGLENLKRLPTAEADLQIVPVEGEPNQSDVVVQWRQRLLPYRVSVGMDNSGSEATGKYQGNITFSADNPLGLSDMFYVNYGRSIGGTPDEESFDGHRKEGGSNNYAVHYSAPFGKWTWAFNHNGYRYHQAVSGLSEVYDYNGKSYNTDFGFNRLLYRDAKRKTYLGVKLWMRETKSYIDDAELTVQRRKTAGWLAELSHKEYIGRSTADFKLKYKRGTGMKDALRAPEEAFGEGTSRMKIWTASADVNTPFQIGKQLFAYDTSVHAQWNKTPLTSQDKLAIGGHHTVRGFDGEMSLSAERGWYWRNDLSWQFKPGHQLYLGADVGHVSGQSAKWLSGQTLVGTAIGIRGQIKLGGNLHYDIFTGRALKKPEFFQSRKWASGFQVGYTF

SEQ ID NO: 1951 - protein, 185 aa, Neisseria
MKPKFKTVLTALLLAVSLPSMAATRVLMETDMGNIRLVLDESKASKTVANFVRYARKGFYDNTIFHRVIGGFVIQGDGLTEDLVQKATDKAVANESGNGLKNTVGTIAMARTAAPDSAAAQFFINLADNGSLDYKNGQYGYTVFGRVESGMDTVSKIARVKTATRGFYQNVPVQPVKIRRVVVGQ

SEQ ID NO: 1952 - protein, 185 aa, Neisseria
  VARIANT (1)...(185): Xaa = Any Amino Acid
MKPKFKTVLTALLLAVSLPSMAATHVLMETDMGNIRLVLDESKAPKTVANFVRYARKGFYDDTVFHRVIDGFVIQGGGLTEDLAQKASDKAVANESGNGLKNTAGTIAMARTTAPDSATSQFFINLADXXSLDYKNGQYGYTVFGRVESGMNTVSKIARVKTATRGFYQNVPVQPVKIRRVVVGQ

SEQ ID NO: 1953 - protein, 185 aa, Neisseria
MKPKFKTVLTALLLAVSLPSMAATHVLMETDMGNIRLVLDESKAPKTVANFVRYARKGFYDNTIFHRVIGGFVIQGGGLTEDLAQKASDKAVANESGNGLKNTVGTIAMARTADPDSATSQFFINLVDNDSLNYKNGQYGYTVFGRVESGMNTVSKIARVKTATRGFYQNVPVQPVKIRRVVVGQ

SEQ ID NO: 1954 - protein, 112 aa, Neisseria; identical to SEQ ID NO: 1886

SEQ ID NO: 1955 - protein, 229 aa, Neisseria
MKKIIASALIATFALTACQDDTQARLERQQKQIEALQQQLAQQADDTVYQLTPEAVKDTIPAQAQANGNNGQPVTGKRRAAVYLRPIDRKLAAAKPDWRGGRRVYRQRAGKQIHTGGQPRQPRRPSRACCLPSVRTPQCAHQQGFEHAQPPCKTTGGAGAALPPDNAPARQLPPSRYARFRQKAVNPARQCRLKGFQTAFLYLLGALLCCRLIFRRHFVSKRLMSGWQF

SEQ ID NO: 1956 - protein, 205 aa, Neisseria
  VARIANT (1)...(205): Xaa = Any Amino Acid
RLEQQQKQIEALQQQLAQQADDTVYQLTPEAVKDTIPAEAQANGNNGQPVTGXRRAAVYLRPIDRKLAAAKPGRRGGRRVYRQRAGKQIHTGRQPRQSRRPARACSLPSVRTPQCAHQQGFEHAQPPCKTTGGAXAALPPDNAPXRQLPPPRYARFRQEAVNPARQCRLKSFQTAFXHLLGTLLCCRLIFRRHFVSKRLMSGWQF

SEQ ID NO: 1957 - protein, 228 aa, Neisseria
  VARIANT (1)...(228): Xaa = Any Amino Acid
MKKIIASALIATFALAACQDDAQARLEQQQKQIEALQQQLAQQADDTVYQLTPEAVKDTIPAEAQANGNNGQPVTXRRAAVYLRPIDRKLAAAKPGRRGGRRVYRQRAGKQIHTGRQPRQSRRPARACRLPSVRTSQCAHQQGFEHAQPPCKTTGGAGAALPPDNAPARQLPPPRHARFRQKAVNPACQCRLKGFQTAFLYLLGTLLCCRLIFRRHFVSKSLMSGWQF

SEQ ID NO: 1958 - protein, 505 aa, Neisseria
MLYFRYGFLVVWCAAGVSAAYGADAPAILDDKALLQVQRSVSDKWAESDWKVENDAPRVVDGDFLLAHPKMLEHSLRDALNGNQADLIASLADLYAKLPDYDAVLYGRARALLAKLAGRPAEAVARYRELHGENAADERILLDLAAAEFDDFRLKSAERHFAEAAKLDLPAPVLENVGRFRKKTEGLTGWRFSGGISPAVNRNANNAAPQYCRQNGGRQICSVSRAERAAGLNYEIEAEKLTPLADNHYLLFRSNIGGTSYYFSKKSAYDDGFGRAYLGWQYKNARQTAGILPFYQVQLSGSDGFDAKTKRVNNRRLPPYMLAHGVGVQLSHTYRPNPGWQFSVALEHYRQRYREQDRAEYNNGRQDGFYVSSAKRLGESATVFGGWQFVRFVPKRETVGGAVNNAAYRRNGVYAGWAQEWRQLGGLNSRVSASYARRNYKGIAAFSTEAQRNREWNVSLALSHDKLSYKGIVPALNYRFGRTESNVPYAKRRNSEVFVSADWRF

SEQ ID NO: 1959 - protein, 505 aa, Neisseria
MLYFRYGFLVVWCAAGVSAAYGADAPAILDDKALLQVQRSVSDKWAESDWKVDNDAPRVVDGDFLLAHPKMLEHSLRDVLNGNQADLIASLADLYAKLPDYDAVLYGRARALLAKLAGRPAEAVARYRELHGENAADERILLDLAAAEFDDFRLKSAERHFAEAEKLDLPAPVLENVGRFRKKAEGLTGWRFSGGISPAVNRNANNAAPQYCRQNGGRQICSVSRAERAAGLNYEIEAEKLTALADNHYLLFRSNIGGTSYYFSKKSAYDDGFGRAYLGWQYKNARQTAGILPFYQVQLSGSDGFDAKTKRVNNRRLPPYMLAHGVGVQLSHTYRPNPGWQFSVALEHYRQRYREQDRAEYNNGRQDGFYVSSAKRLGESATVFGGWQFVRFVPKRETVGGAVNNAAYRRNGVYAGWAQEWRQLGGLNSRVSASYARRNYKGVAAFSTEAQRNREWNVSLALSHDKLSYKGIVPALNYRFGRTESNVPYAKRRNSEVFVSADWRF

SEQ ID NO: 1960 - protein, 202 aa, Neisseria
MKPKPHTVRTLIAAVLSLALGGCFSAVVGGAAVGAKSVIDRRTTGAQTDDNVMALRIETTARSYLRQNNQTKGYTPQISVVGYNRHLLLLGQVATEGEKQFVGQIARSEQAAEGVYNYITVASLPRTAGDIAGDTWNTSKVRATLLGISPATQARVKIITYGNVTYVMGILTPEEQAQITQKVSTTVGVQKVITLYQNYVQR

SEQ ID NO: 1961 - protein, 128 aa, Neisseria
MKPKPHTVRTLIAAIFSLALSGCVSAVIGSAAVGAKSAVDRRTTGAQTDDNVMALRIETTARSYLRQNNQTKGYTPQISVVGYNRHLLLLGQVATEGEKQFVGQIARSEQAAEGVYNYITVASLPRTA

SEQ ID NO: 1962 - protein, 202 aa, Neisseria
MKPKPHTVRTLTAAVLSLALGGCVSAVVGGAAVGAKSAVDRRTTGAQTDDNVMALRIETTARSYLRQNNQTKGYTPQISVVGYNRHLLLLGQVATEGEKQFVGQIARSEQAAEGVYNYITVASLPRTAGDIAGDTWNTSKVRATLLGISPATQARVKIVTYGNVTYVMGILTPEEQAQITQKVSTTVGVQKVITLYQNYVQR

SEQ ID NO: 1963 - protein, 202 aa, Neisseria; identical to SEQ ID NO: 1960

SEQ ID NO: 1964 - protein, 202 aa, Neisseria
MKPKPHTVRTLIAAIFSLALSGCVSAVIGSAAVGAKSAVDRRTTGAQTDDNVMALRIETTARSYLRQNNQTKGYTPQISVVGYNRHLLLLGQVATEGEKQFVGQIARSEQAAEGVYNYITVASLPRTAGDIAGDTWNTSKVRATLLGISPATQARVKIVTYGNVTYVMGILTPEEQAQITQKVSTTVGVQKVITLYQNYVQR

SEQ ID NO: 1965 - protein, 202 aa, Neisseria; identical to SEQ ID NO: 1962

SEQ ID NO: 1966 - protein, 288 aa, Neisseria
MKNILLVFVSFVPLCVRTDLPLNIEDIMTDKGKWKLETSLTYLNSENSRAALASPVYIQTGSASFIPVPTEIQENGSNTDMLAGTLGLRYGLTGNTDIYGSGSYLWHEERKLDGNGKTRNKRMSDISAGISHTFLKDGKNPALIAFLESTVYEKSRNKASSGKSWLIGATTYKAIDPIVLSLTAAYRINGSKTLSDDVKYKAGNYWMLNPNISFAANDRISLTGGIQWLGKQPDRIDGKKESARNTSTYAHFGAGFGFTKTAALNASARFNVSGQSSSELKLGVQHTF

SEQ ID NO: 1967 - protein, 289 aa, Neisseria
MKRIFLPALPAILPLSTYADLPLTIEDIMTDKGKWKLETSLTYLNSENNRAELAAPVYIQTGATSFIPIPTEIQENGSNTDMLVGTLGLRYGLTGNTDIYGSGSYLWHEERKLDGNSKTRNKRMSDVSLGISHTFLKDDKNPALISFLESTVYEKSRNKASSGKSWLIGATTYKAIDPIVLSLTAAYRINGSKTLSDGIRYKSGNYLLLNPNISFAANDRISLTGGIQWLGRQPDRTDGKRESSRNTSTYAHFGAGFGFTKTTALNASARFNVSGQSSSELKFGVQHTF

SEQ ID NO: 1968 - protein, 289 aa, Neisseria; identical to SEQ ID NO: 1432

SEQ ID NO: 1969 - protein, 74 aa, Neisseria
MKRLTLLAFVLAAGAVSASPKADVEKGKQVAATVCAACHAADGNSGIAMYPRLAAQHTAYIYHQTIGIRDVNAP

SEQ ID NO: 1970 - protein, 207 aa, Neisseria
MKRLTLLAFVLAAGAVSASPKADVEKGKQVAATVCAACHAADGNSGIAMYPRLAAQHTAYIYHQTIGIRDGKRTHGSAAVMKPVVMNLSDQDILNVSAFYAKQQPKSGEANPKENPELGAKIYRGGLSDKKVPACMSCHGPSGAGMPGGGSEIQAYPRLGGQHQAYIVEQMNAYKSGQRKNTIMEDIANRMSEEDLKAVANFIQGLR

SEQ ID NO: 1971 - protein, 112 aa, Neisseria; identical to SEQ ID NO: 1726

SEQ ID NO: 1972 - protein, 102 aa, Neisseria; identical to SEQ ID NO: 1727

SEQ ID NO: 1973 - protein, 102 aa, Neisseria; identical to SEQ ID NO: 1727

SEQ ID NO: 1974 - protein, 614 aa, Neisseria
MIMLPARFTILSVLAAALLAGQAYAAGAADVELPKEVGKVLRKHRRYSEEEIKNERARLAAVGERVNRVFTLLGGETALQKGQAGTALATYMLMLERTKSPEVAERALEMAVSLNAFEQAEMIYQKWRQIEPIPGEAQKRAGWLRNVLREGGNQHLDGLEEVLAQSDDVQKRRIFLLLVQAAVQQGGVAQKASKAVRRAALKYEHLPEAAVADAVFGVQGREKEKAIEALQRLAKLDTEILPPTLMTLRLTARKYPEILDGFFEQTDTQNLSAVWQEMEIMNLVSLRKPDDAYARLNVLLEHNPNANLYIQAAILAANRKEGASVIDGYAEKAYGRGTGEQRGRAAMTAAMIYADRRDYAKVRQWLKKVSAPEYLFDKGVLAAAAAAELDGGRAALRQIGRVRKLPEQQGRYFTADNLSKIQMLALSKLPDKREALIGLNNIIAKLSAAGSTEPLAEALAQRSIIYEQFGKRGKMIADLETALKLTPDNAQIMNNLGYSLLSDSKRLDEGFALLQTAYQINPDDTAVNDSIGWAYYLKGDAESALPYLRYSFENDPEPEVAAHLGEVLWALGERDQAVDVWTQAAHLRGDKKIWRETLKRYGIALPEPSRKPRK

SEQ ID NO: 1975 - protein, 616 aa, Neisseria
MIMLPNRFKMLTVLTATLIAGQVSAAGGGAGDMKQPKEVGKVFRKQQRYSEEEIKNERARLAAVGERVNQIFTLLGGETALQKGQAGTALATYMLMLERTKSPEVAERALEMAVSLNAFEQAEMIYQKWRQIEPIPGKAQKRAGWLRNVLRERGNQHLDGLEEVLAQADEGQNRRVFLLLAQAAVQQDGLAQKASKAVRRAALKYEHLPEAAVADVVFSVQGREKEKAIGALQRLAKLDTEILPPTLMTLRLTARKYPEILDGFFEQTDTQNLSAVWQEMEIMNLVSLHRLDDAYARLNVLLERNPNADLYIQAAILAANRKEGASVIDGYAEKAYGRGTEEQRSRAALTAAMMYADRRDYAKVRQWLKKVSAPEYLFDKGVLAAAAAVELDGGRAALRQIGRVRKLPEQQGRYFTADNLSKIQMLALSKLPDKREALRGLDKIIEKPPAGSNTELQAEALVQRSVVYDRLGKRKKMISDLERAFRLAPDNAQIMNNLGYSLLTDSKRLDEGFALLQTAYQINPDDTAVNDSIGWAYYLKGDAESALPYLRYSFENDPEPEVAAHLGEVLWALGERDQAVDVWTQAAHLTGDKKIWRETLKRHGIALPQPSRKPRK

SEQ ID NO: 1976 - protein, 612 aa, Neisseria
MLPARFTILSVLAAALLAGQAYAAGAADAKPPKEVGKVFRKQQRYSEEEIKNERARLAAVGERVNQIFTLLGGETALQKGQAGTALATYMLMLERTKSPEVAERALEMAVSLNAFEQAEMIYQKWRQIEPIPGKAQKRAGWLRNVLRERGNQHLDGLEEVLAQADEGQNRRVFLLLAQAAVQQDGLAQKASKAVRRAALRYEHLPEAAVADVVFSVQGREKEKAIGALQRLAKLDTEILPPTLMTLRLTARKYPEILDGFFEQTDTQNLSAVWQEMEIMNLVSLHRLDDAYARLNVLLERNPNADLYIQAAILAANRKEGASVIDGYAEKAYGRGTGEQRGRAAMTAAMIYADRRDYTKVRQWLKKVSAPEYLFDKGVLAAAAAVELDGGRAALRQIGRVRKLPEQQGRYFTADNLSKIQMFALSKLPDKREALRGLDKIIEKPPAGSNTELQAEALVQRSVVYDRLGKRKKMISDLERAFRLAPDNAQIMNNLGYSLLSDSKRLDEGFALLQTAYQINPDDTAVNDSIGWAYYLKGDAESALPYLRYSFENDPEPEVAAHLGEVLWALGERDQAVDVWTQAAHLTGDKKIWRETLKRHGIALPQPSRKPRK

SEQ ID NO: 1977 - protein, 202 aa, Neisseria
LSYRLNAAPMFNDNPVVYGKIKLQSWKARRDFNIVKQDLDFSCGAASVATLLNNFYGQKLTEEEVLEKLGKEQMRASFEDMRRIMPDLGFEAKGYALSFEQLAQLKIPVIVYLKYRKDDHFSVLRGVDGNTVLLADPSPGHVSMSRAQFLEAWQTREGNLAGKILAVVPKKAEAISNKLFFTHHPKRQTEFAVGQVKWWRAY

SEQ ID NO: 1978 - protein, 218 aa, Neisseria
MMKFKYVFLLACVVVSLSYRLNAAPMFNDNPVVYGKIKVQSWKARRDFNIVKQDLDFSCGAASVATLLNNFYGQTLTEEEVLKKLDKEQMRASFEDMRRIMPDLGFEAKGYALSFEQLAQLKIPVIVYLKYRKDDHFSVLRGIDGNTVLLADPSLGHVSMSRAQFLDAWQTREGNLAGKILAVIPKKAETISNKLFFTQHPKRQTEFTVGQIRQARAE

SEQ ID NO: 1979 - protein, 218 aa, Neisseria
  VARIANT (1)...(218): Xaa = Any Amino Acid
MMKFKYVFLLACVVVSLSYRLNAAPMFNDNPVVYGKIKVQSWKERRDFNIVKQDLDFSCGAASVATLLNNFYGQTLTEEEVLKKLDKEQMRASFEDMRRIMPDLGFEAKGYALSFEQLAQLKIPVIVYLKYRKDDHFSVLRGIDGNTVLLADPSLGHVSMSRAQFXDAWQTREGNLAGKILAVVPKKAETISNKLFFTHHPKRQTEFAVGQIRQARAE

SEQ ID NO: 1980 - protein, 186 aa, Neisseria
MKKIIFAALAAAAVGTASATYKVDEYHANVRFAIDHFNTSTNVGGFYGLTGSVEFDQAKRDGKIDITIPVANLQSGSQPFTGHLKSADIFDAAQYPDIRFVSTKFNFNGKKLVSVDGNLTMRGKTAPVKLKAEKFNCYQSPMAETEVCGGDFSTTIDRTKWGVDYLVNAGMTKNVRIDIQIEAAKQ

SEQ ID NO: 1981 - protein, 187 aa, Neisseria
MKKIIFAALAAAAISTASAATYKVDEYHANARFAIDHFNTSTNVGGFYGLTGSVEFDQAKRDGKIDITIPIANLQSGSQHFTDHLKSADIFDAAQYPDIRFVSTKFNFNGKKLVSVDGNLTMHGKTAPVKLKAEKFNCYQSPMEKTEVCGGDFSTTIDRTKWGMDYLVNVGMTKSVRIDIQIEAAKQ

SEQ ID NO: 1982 - protein, 187 aa, Neisseria
MKKIIIAALAAAAIGTASAATYKVDEYHANARFSIDHFNTSTNVGGFYGLTGSVEFDQAKRDGKIDITIPVANLQSGSQHFTDHLKSADIFDAAQYPDIRFVSTKFNFNGKKLVSVDGNLTMHGKTAPVKLKAEKFNCYQSPMLKTEVCGGDFSTTIDRTKWGMDYLVNVGMTKSVRIDIQIEAAKQ

SEQ ID NO: 1983 - protein, 158 aa, Neisseria
MKKFYFVLLALGLAACGQEQSQKADAEQYFFANKYQFADEKQAFYFERAARFRVLQQGLGGDFERFLKGEIPNQENLAKYRENITQAVAYYADTNGDDDPYRVCKQAAQDAEILMKSMVTSGGGGTTDLDKESYQNYRKSMQECRKTITEAEANLPKK

SEQ ID NO: 1984 - protein, 331 aa, Neisseria
MFKKFKPVLLSFFALVFAFWLGTGIAYEINPRWFLSDTATEVPENPNAFVAKLARLFRNADRAVVIVKESMRTEESLAGAVDDGPLQSEKDYLALAIRLSRLKEKAKWFHVTEQEHGEEVWLDYYIGEGGLVAVSLSQRSPEAFVNAEYLYRNDRPFSVNVYGGTAHGENYETTGEYRVVWQPDGSVFDAAGRGKIGEDVYEHCLGCYQMAQVYLAKYRDVANDEQKVWDFREESNRIASDSRDYVFYQNMRELMPRGMKANSLVVGYDADGLPQKVYWSVDNGKKPQSVEYYLKNGNLFIAQSSTVTLKTDGVTADMQTYHAQQTLYLDG

SEQ ID NO: 1985 - protein, 377 aa, Neisseria; identical to SEQ ID NO: 1752

SEQ ID NO: 1986 - protein, 374 aa, Neisseria; identical to SEQ ID NO: 1753

SEQ ID NO: 1987 - protein, 801 aa, Neisseria
LARLFSLKPLVLALGFCFGTHCAADTVAAEEADGRVAEGGAQGASESAQASDLTLGSTCLFCSNESGSPERTEAAVQGSGEASVPEDYTRIVADRMEGQSKVKVRAEGSVIIERDGAVLNTDWADYDQSGDTVTVGDRFALQQDGTLIRGETLTYNLDQQTGEAHNVRMETEQGGRRLQSVSRTAEMLGEGRYKLTETQFNTCSAGDAGWYVKAASVEADRGKGIGVAKHAAFVFGGVPLFYTPWADFPLDGNRKSGLLVPSVSAGSDGVSLSVPYYFNLAPNFDATFAPGIIGERGATFDGQIRYLRPDYSGQTDLTWLPHDKKSGRNNRYQAKWQHRHDISDTLQAGVDFNQVSDSGYYRDFYGGEEIAGNVNLNRRVWLDYGGRAAGGSLNAGLSVQKYQTLANQSGYKDEPYAIMPRLSADWHKNAGRAQIGVSAQFTRFSHDGRQDGSRLVVYPGIKWDFSNSWGYVRPKLGLHATYYSLDSFGGKASRSVGRVLPVVNIDGGTTFERNTRLFGGGVVQTIEPRLFYNYIPAKSQNDLPNFDSSESSFGYGQLFRENLYYGNDRINAANSLSTAVQSRILDGATGEERFRAGIGQKFYFKDDAVMLDGSVGKNPRSRSDWVAFASGGIGGRFTLDSSIHYNQNDKRAEHYAVGAGYRPAPGKVLNARYKYGRNEKIYLQADGSYFYDKLSQLDLSAQWPLTRNLSAVVRYNYGFEAKKPIEMLAGAEYKSSCGCWGAGVYAQRYVTGENTYKNAVFFSLQLKDLSSVGRNPAGRMDVAVPGYIPAHSLSAGRNKRP

SEQ ID NO: 1988 - protein, 802 aa, Neisseria
LARLFSLKPLVLALGLCFGTHCAAADAVAAEETDNPTAGESVRSVSEPIQPTSLSLGSTCLFCSNESGSPERTEAAVQGSGEASIPEDYTRIVADRMEGQSQVQVRAEGNVVVERNRTTLNTDWADYDQSGDTVTAGDRFALQQDGTLIRGETLTYNLEQQTGEAHNVRMEIEQGGRRLQSVSRTAEMLGEGHYKLTETQFNTCSAGDAGWYVKAASVEADREKGIGVAKHAAFVFGGVPIFYTPWADFPLDGNRKSGLLVPSLSAGSDGVSLSVPYYFNLAPNLDATFAPSVIGERGAVFDGQVRYLRPDYAGQSDLTWLPHDKKSGRNNRYQAKWQHRHDISDTLQAGVDFNQVSDSGYYRDFYGNKEIAGNVNLNRRVWLDYGGRAAGGSLNAGLSVLKYQTLANQSGYKDKPYALMPRLSVEWRKNTGRAQIGVSAQFTRFSHDSRQDGSRLVVYPDIKWDFSNSWGYVRPKLGLHATYYSLNRFGSQEARRVSRTLPIVNIDSGATFERNTRMFGGEVLQTLEPRLFYNYIPAKSQNDLPNFDSSESSFGYGQLFRENLYYGNDRINTANSLSAAVQSRILDGATGEERFRAGIGQKFYFKDDAVMLDGSVGKKPRNRSDWVAFASGSIGSRFILDSSIHYNQNDKRAENYAVGASYRPAQGKVLNARYKYGRNEKIYLKSDGSYFYDKLSQLDLSAQWPLTRNLSAVVRYNYGFEAKKPIEVLAGAEYKSSCGCWGAGVYAQRYVTGENTYKNAVFFSLQLKDLSSVGRNPADRMDVAVPGYITAHSLSAGRNKRP

SEQ ID NO: 1989 - protein, 802 aa, Neisseria
LARLFSLKPLVLALGFCFGTHCAAADAVAAEETDNPTAGGSVRSVSEPIQPTSLSLGSTCLFCSNESGSPERTEAAVQGSGEASIPEDYTRIVADRMEGQSQVQVRAEGNVVVERNRTTLNADWADYDQSGDTVTAGDRFALQQDGTLIRGETLTYNLEQQTGEAHNVRMETEHGGRRLQSVSRTAEMLGEGHYKLTETQFNTCSAGDAGWYVKAASVEADREKGIGVAKHAAFVFGGVPIFYTPWADFPLDGNRKSGLLVPSLSAGSDGVSLSVPYYFNLAPNLDATFAPGVIGERGAVFDGQVRYLRPDYAGQSDLTWLPHDKKSGRNNRYQAKWQHRHDISDTLQAGVDFNQVSDSGYYRDFYGNKEIAGNVNLNRRVWLDYGGRAAGGSLNAGLSVLKYQTLANQSGYKDKPYALMPRLSADWRKNTGRAQIGVSAQFTRFSHDSRQDGSRLVVYPDIKWDFSNSWGYVRPKLGLHATYYSLNRFGSQEARRVSRTLPIVNIDSGMTFERNTRMFGGGVLQTLEPRLFYNYIPAKSQNDLPNFDSSESSFGYGQLFRENLYYGNDRINTANSLSAAVQSRILDGATGEERFRAGIGQKFYFKNDAVMLDGSVGKKPRSRSDWVAFASSGIGSRFILDSSIHYNQNDKRAENYAVGASYRPAQGKVLNARYKYGRNEKIYLKSDGSYFYDKLSQLDLSAQWPLTRNLSAVVRYNYGFEAKKPIEVLAGAEYKSSCGCWGAGVYAQRYVTGENTYKNAVFFSLQLKDLSSVGRNPADRMDVAVPGYIPAHSLSAGRNKRP

SEQ ID NO: 1990 - protein, 108 aa, Neisseria; identical to SEQ ID NO: 1777

SEQ ID NO: 1991 - protein, 108 aa, Neisseria; identical to SEQ ID NO: 1778

SEQ ID NO: 1992 - protein, 108 aa, Neisseria; identical to SEQ ID NO: 1779

SEQ ID NO: 1993 - protein, 540 aa, Neisseria
MQVNIQIPCMLYRRGSVKPPLFEAPRLLPSFTDPVVPKLSAPGGYIVDIPKGNLKTEIEKLAKQPEYAYLKQLQVAKNVNWNQVQLAYDKWDYKQEGLTRAGAAIIALAVTVVTAGAGVGAALGLNGAAAAAADAAFASLASQASVSLINNKGDVGKTLKELGRSRTVKNLVVAAATAGVSNKLGASSLATWSETPWVNNLNVNLANAGSAALINTAVNGGSLKDNLEANILAALVNTAHGEAASKIKGLDQHYVAHKIAHAVAGCAAAAANKGKCQDGAIGAAVGEIVGEALVKNTDFSDMTPEQLDLEVKKITAYAKLAAGTVAGVTGGDVNTAAQTAQNAVENNAVKAVVTAAKVVYKVARKGLKNGKINVRDLKQTLKDEGYNLADNLTTLFDETLDWNDAKAVIDIVVGTELNRANKGEAAQKVKEVLEKNRPYIPNKGAVPNMSTYMKNNPFGKQLAQISEKTTLPTQQGQSVFLVKRNQGLLKTGDRFYLDGQHKNHLEVFDKNGNFKFVLNMDGSLNQMKTGAAKGRKLNLK

SEQ ID NO: 1994 - protein, 364 aa, Neisseria
MSMKHFPAKVLTTAILATFCSGALAATSDDDVKKAATVAIVAAYNNGQEINGFKAGETIYDIGEDGTITQKDATAADVEADDFKGLGLKKVVTNLTKTVNENKQNVDAKVKAAESEIEKLTTKLADTDAALADTDAALDETTNALNKLGENITTFAEETKTNIVKIDEKLEAVADTVDKHAEAFNDIADSLDETNTKADEAVKTANEAKQTAEETKQNVDAKVKAAETAAGKAEAAAGTANTAADKAEAVAAKVTDIKADIATNKADIAKNSARIDSLDKNVANLRKETRQGLAEQAALSGLFQPYNVGRFNVTAAVGGYKSESAVAIGTGFRFTENFAAKAGVAVGTSSGSSAAYHVGVNYEW

SEQ ID NO: 1995 - protein, 422 aa, Neisseria
  VARIANT (1)...(422): Xaa = Any Amino Acid
LTNRGGAKLKTXSKSSERMSEVEYFSHFISDGKGKLLEIPQRRGKQDGVFVDWISFTFHEDTLLKVSGCPLFSDAEYMYVLSRKLEEILGFGITRKCKSRGNKFYESMYRLGSDDVDYGEVHFGXQRNTVLVELKGTGCSVASPGWELRLKQFLDDSIRTRITRIDLALDFFDGEYTPDQALLDHDNGFFDNSNQRPKSETIGTAWRNEDGSGKTFYVGRKKNSRFVRVYEKGRQLGDKESKWVRFEIQFNYGDIEIPLDILINQGSYFCGAFPICRKFKNMPVPERFDQRKKKLNLTFEHKLHYAKNAVGKLVNFMIEMGFDNSEIVESLKADSGFPKGLEPEKYALEMLRDGLKHGFIHEQPDIDLEIELDELGVIAFKNSDKFDREKRLFSPDYDVEKERKYQEYLSKVYHQNVDYDYF

SEQ ID NO: 1996 - protein, 422 aa, Neisseria
LTNRGGAKLKTNSKSSERMSEVEYFSHFISDGKGKLLEIPQRRGKQDGVFVDWISFTFHEDTLLKVSGCPLFSDAEYMYVLSRKLEEILGFGITRKCKSRGNKFYESMYRLGSDDVDYGEVHFGGQRNTVLVELKGTGCSVASPGWELRLKQFLDDSIRTRITRIDLALDFFDGEYTPDQALLDHDNGFFDNSNQRPKSETIGTAWRNEDGSGKTFYVGRKKNSRFVRVYEKGRQLGDKESKWVRFEIQFNYGDIEIPLDILINQGSYFCGAFPICRKFKNMPVPERFDQRKKTLNLTFEHKLHYAKNAVGKLVNFMIEMGFDNSEIVESLKADSGFPKGLEPEKYALEMLRDGLKHGFIHEQPDIDLEIELDELGVIAFKNSDKFDREKRLFSPDYDVEKERKYQEYLSKVYHQNVDYDYF

SEQ ID NO: 1997 - protein, 274 aa, Neisseria
MDGAQPKTNFFERLIARLAREPDSAEDVLNLLRQAHEQEVFDADTLTRLEKVLDFAELEVRDAMITRSRMNVLKENDSIERITAYVIDTAHSRFPVIGEDKDEVLGILHAKDLLKYMFNPEQFHLKSVLRPAVFVPEGKSLTALLKEFREQRNHMAIVIDEYGGTSGLVTFEDIIEQIVGDIEDEFDEDESADDIHSVSAERWRIHAATEIEDINAFFGTEYGSEEADTIGGLVIQELGHLPVRGEKVLIGGLQFTVARADNRRLHTLMATRVK

SEQ ID NO: 1998 - protein, 274 aa, Neisseria
  VARIANT (1)...(274): Xaa = Any Amino Acid
MDGAQPKTNFFERLIARLAREPDSAEDVLNLLRQAHEQEVFDADTLLRLEKVLDFSDLEVRDAMITRSRMNVLKENDSIERITAYVIDTAHSRFPVIGEDKDEVLGILHAKDLLKYMFNPEQFHLKSILRPAVFVPEGKSLTALLKEFREQRNHMAIVIDEYGGTSGLVTFEDIIEQIVGEIEDEFDEDDSADNIHAVSSERWRIHAATEIEDINTFFGTEYSXEEADTIGGLVIQELGHLPVRGEKVLIGGLQFTVARADNRRLHTLMATRVK

SEQ ID NO: 1999 - protein, 274 aa, Neisseria
MDGAQPKTNFFERLIARLAREPDSAEDVLTLLRQAHEQEVFDADTLLRLEKVLDFSDLEVRDAMITRSRMNVLKENDSIERITAYVIDTAHSRFPVIGEDKDEVLGILHAKDLLKYMFNPEQFHLKSILRPAVFVPEGKSLTALLKEFREQRNHMAIVIDEYGGTSGLVTFEDIIEQIVGDIEDEFDEDESADNIHAVSAERWRIHAATEIEDINAFFGTEYSSEEADTIGGLVIQELGHLPVRGEKVLIGGLQFTVARADNRRLHTLMATRVK

SEQ ID NO: 2000 - protein, 266 aa, Neisseria
MKKWIAAALACSALALSACGGQGKDAAAPAANPGKVYRVASNAEFAPFESLDSKGNVEGFDVDLMNAMAKAGNFKIEFKHQPWDSLFPALNNGDADVVMSGVTITDDRKQSMDFSDPYFEITQVVLVPKGKKVSSSEDLKKMNKVGVVTGHTGDFSVSKLLGNDNPKIARFENVPLIIKELENGGLDSVVSDSAVIANYVKNNPAKGMDFVTLPDFTTEHYGIAVRKGDEATVKMLNDALEKVRESGEYDKIYAKYFAKEGGQAAK

SEQ ID NO: 2001 - protein, 266 aa, Neisseria
MKKWIAAALACSALALSACGGQGKDTAAPAANPDKVYRVASNAEFAPFESLDSKGNVEGFDVDLMNAMAKAGNFKIEFKHQPWDSLFPALNNGDADVVMSGVTITDDRKQSMDFSDPYFEITQVVLVPKGKKVSSSEDLKNMNKVGVVTGYTGDFSVSKLLGNDNPKIARFENVPLIIKELENGGLDSVVSDSAVIANYVKNNPAKGMDFVTLPDFTTEHYGIAVRKGDEATVKMLNDALEKVRESGEYDKIYAKYFAKEDGQAAK

SEQ ID NO: 2002 - protein, 266 aa, Neisseria
MKKWIAAALACSALALSACGGQGKDAAAPAANPDKVYRVASNAEFAPFESLDSKGNVEGFDVDLMNAMAKAGNFKIEFKHQPWDSLFPALNNGDADVVMSGVTITDDRKQSMDFSDPYFEITQVVLVPKGKKISSSEDLKNMNKVGVVTGYTGDFSVSKLLGNDNPKIARFENVPLIIKELENGGLDSVVSDSAVIANYVKNNPTKGMDFVTLPDFTTEHYGIAVRKGDEATVKMLNDALKKVRESGEYDKIYAKYFAKEDGQAAK

SEQ ID NO: 2003 - protein, 544 aa, Neisseria
IASQNLRFDNRFLQKMVNGVNILPAADWVALGAKGRNVVVDRAFGGPHITKDGVTVAKEIELKDKFENMGAQMVKEVASKTNDVAGDGTTTATVLAQSIVAEGMKYVTAGMNPTDLKRGIDKAVAALVEELKNIAKPCDTSKEIAQVGSISANSDEQVGAIIAEAMEKVGKEGVITVEDGKSLENELDVVEGMQFDRGYLSPYFINDAEKQIAGLDNPFVLLFDKKISNIRDLLPVLEQVAKASRPLLIIAEDVEGEALATLVVNNIRGILKTVAVKAPGFGDRRKAMLQDIAILTGGVVISEEVGLSLEKATLDDLGQTKRIEIGEENTTVIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQDAGVQIVLRAVESPLRQIVANAGGEPSVVVNKVLEGKGNYGYNAGSGEYGDMIGMGVLDPAKVTRSALQHAASIAGLMLTTDCMIAEIPEEKPAVPDMGGMGGMGGMM

SEQ ID NO: 2004 - protein, 1635 aa, Neisseria
ATGGCAGCAAAAGACGTACAGTTCGGCAATGAAGTCCGTCAAAAAATGGTAAACGGCGTGAACATTCTGGCAAACGCCGTCCGCGTAACCTTGGGCCCCAAAGGTCGCAACGTAGTCGTTGACCGCGCATTCGGCGGCCCGCACATCACCAAAGACGGCGTAACCGTCGCCAAAGAAATCGAACTGAAAGACAAGTTTGAAAATATGGGCGCGCAAATGGTGAAAGAAGTTGCGTCCAAAACCAACGACGTGGCAGGCGACGGTACGACTACCGCCACCGTACTGGCGCAATCCATCGTTGCCGAAGGTATGAAATATGTTACCGCAGGTATGAATCCGACCGACCTGAAACGCGGTATCGATAAAGCCGTCGCCGCTTTGGTTGACGAACTGAAAAACATCGCCAAACCTTGCGACACTTCTAAAGAAATCGCCCAAGTCGGCTCTATTTCCGCCAACTCCGACGAACAAGTCGGCGCGATTATCGCCGAAGCGATGGAAAAAGTCGGCAAAGAAGGCGTGATTACCGTTGAAGACGGCAAGTCTTTGGAAAACGAGCTGGACGTAGTTGAAGGTATGCAGTTCGACCGCGGCTACCTGTCTCCTTACTTCATCAACGATGCGGAAAAACAAATCGCTGCTTTGGACAATCCGTTTGTATTGTTGTTCGACAAAAAAATCAGCAACATCCGCGACCTGCTGCCTGTTTTGGAACAAGTGGCAAAAGCCAGCCGTCCGCTGTTGATTATCGCTGAAGACGTAGAAGGCGAAGCCTTGGCGACTTTGGTCGTGAACAACATCCGAGGCATCCTGAAAACCGTTGCCGTCAAAGCCCCTGGCTTCGGCGACCGCCGCAAAGCGATGTTGCAAGACATCGCCATCCTGACCGGCGGCGTGGTGATTTCCGAAGAAGTCGGTCTGTCTTTGGAAAAAGCGACTTTGGACGACTTGGGTCAAGCCAAACGCATCGAAATCGGTAAAGAAAACACCACCATCATCGACGGCTTTGGCGACGCAGCCCAAATCGAAGCGCGTGTTGCCGAAATCCGCCAACAAATCGAAACCGCAACCAGCGATTACGACAAAGAAAAACTGCAAGAGCGCGTGGCTAAATTGGCAGGCGGCGTGGCAGTCATCAAAGTCGGTGCCGCGACCGAAGTCGAAATGAAAGAGAAAAAAGACCGCGTGGAAGACGCGCTGCACGCTACCCGCGCAGCCGTTGAAGAAGGCGTGGTTGCAGGCGGCGGCGTAGCCCTGTTGCGTGCCCGTGCTGCTTTGGAAAACCTGCACACCGGCAATGCCGACCAAGACGCAGGCGTACAAATCGTCTTGCGCGCCGTTGAGTCTCCGCTGCGCCAAATCGTTGCCAACGCAGGCGGCGAACCCAGCGTGGTTGTGAACAAAGTATTGGAAGGCAAAGGCAACTACGGTTACAACGCTGGCAGCGGCGAATACGGCGATATGATCGAAATGGGCGTACTCGACCCCGCCAAAGTAACCCGTTCTGCGCTGCAACACGCCGCATCTATCGCCGGCTTGATGCTGACCACTGATTGCATGATCGCTGAAATCCCCGAAGACAAACCGGCTGTGCCTGATATGGGCGGCATGGGTGGTATGGGCGGCATGATGTAA

SEQ ID NO: 2005 - protein, 544 aa, Neisseria
MAAKDVQFGNEVRQKMVNGVNILANAVRVTLGPKGRNVVVDRAFGGPHITKDGVTVAKEIELKDKFENMGAQMVKEVASKTNDVAGDGTTTATVLAQSIVAEGMKYVTAGMNPTDLKRGIDKAVAALVEELKNIAKPCDTSKEIAQVGSISANSDEQVGAIIAEAMEKVGKEGVITVEDGKSLENELDVVEGMQFDRGYLSPYFINDAEKQIAGLDNPFVLLFDKKISNIRDLLPVLEQVAKASRPLLIIAEDVEGEALATLVVNNIRGILKTVAVKAPGFGDRRKAMLQDIAILTGGTVISEEVGLSLEKATLDDLGQAKRIEIGKENTTIIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQDAGVQIVLRAVESPLRQIVANAGGEPSVVVNKVLEGKGNYGYNAGSGEYGDMIEMGVLDPAKVTRSALQHAASIAGLMLTTDCMIAEIPEDKPAMPDMGGMGGMGGMM

SEQ ID NO: 2006 - protein, 499 aa, Neisseria
VFKKYQYFALAALCAALLAGCEKAGSFFGADKKEASFVERIEHTKDDGSVSMLLPDFAQLVQSEGPAVVNIQAAPAPRTQNGSGNAETDSDPLADSDPFYEFFKRLVPNMPEIPQEEADDGGLNFGSGFIISKNGYILTNTHVVAGMGSIKVLLNDKREYTAKLIGSDVQSDVALLKIDATEELPVVKIGNPKNLKPGEWVAAIGAPFGFDNSVTAGIVSAKGRSLPNESYTPFIQTDVAINPGNSGGPLFNLKGQVVGINSQIYSRSGGFMGISFAIPIDVAMNVAEQLKNTGKVQRGQLGVIIQEVSYGLAQSFGLDKASGALIAKILPGSPAERAGLQAGDIVLSLDGGEIRSSGDLPVMVGAITPGKEVSLGVWRKGEEITIKAKLGNAAEHTGASSKTDEAPYTEQQSGTFSVESAGITLQTHTDSSGKHLVVVRVSDAAERAGLRRGDEILAVGQVPVNDEAGFRKAMDKAGKNVPLLVMRRGNTLFIALNLQ

SEQ ID NO: 2007 - protein, 499 aa, Neisseria
VFKKYQYLALAALCAASLAGCDKAGSFFVADKKEASFVERIEHTKDDGSVSMLLPDFAQLVQSEGPAVVNIQAAPAPRTQNGSGNAENDSDPIADNDPFYEFFKRLVPNMPEIPQEEADDGGLNFGSGFIISKDGYILTNTHVVTGMGSIKVLLNDKREYTAKLIGSDVQSDVALLKIDATEELPVVKIGNPKDLKPGEWVAAIGAPFGFDNSVTAGIVSAKGRSLPNESYTPFIQTDVAINPGNSGGPLFNLKGQVVGINSQIYSRSGGFMGISFAIPIDVAMNVAEQLKNTGKVQRGQLGVIIQEVSYGLAQSFGLDKAGGALIAKILPGSPAERAGLQAGDIVLSLDGGEIRSSGDLPVMVGAITPGKEVSLGVWRKGEEITIKVKLGNAAEHIGASSKTDEAPYTEQQSGTFSVESAGITLQTHTDSSGGHLVVVRVSDAAERAGLRRGDEILAVGQVPVNDEAGFRKAMDKAGKNVPLLIMRRGNTLFIALNLQ

SEQ ID NO: 2008 - protein, 499 aa, Neisseria
  VARIANT (1)...(499): Xaa = Any Amino Acid
VFKKYQYLALAALCAASLAGCDKAGSFFGADKKEASFVERIKHTKDDGSVSMLLPDFVQLVQSEGPAVVNIQAAPAPRTQNGSSNAETDSDPLADSDPFYEFFKRLVPNMPEIPQEEADDGGLNFGSGFIISKDGYILTNTHVVTGMGSIKVLLNDKREYTAKLIGSDVQSDVALLKIDATEELPVVKIGNPKDLKPGEWVAAIGAPFGFDNSVTAGXVSAKGRSLPNESYTPFIQTDVAINPGNSGGPLFNLKGQVVGINSQIYSRSGGFMGISFAIPIDVAMNVAEQLKNTGKVQRGQLGVIIQEVSYGLAQSFGLDKAGGALIAKILPGSPAERAGLRAGDIVLSLDGGEIRSSGDLPVMVGAITPGKEVSLGVWRKGEEITIKVKLGNAAEHIGASSKTDEAPYTEQQSGTFSVESAGITLQTHTDSSGGHLVVVRVSDAAERAGLRRGDEILAVGQVPVNDEAGFRKAMDKAGKNVPLLIMRRGNTLFIALNLQ

SEQ ID NO: 2009 - protein, 507 aa, Neisseria
MKTRSLISLLCLLLCSCSSWLPPLEERTESRHFNTSKPVLLDNILQIRHTPHNNGLSDIYLLDDPHEAFAARAALIESAEHSLDLQYYIWRNDISGRLLFNLMYLAAERGVRVRLLLDDNNTRGLDDLLLALDSHPNIVRLFNPFVLRKWRALGYLTDFPRLNRRMHNKSFTADNRATILGGRNIGDEYFKVGEDTVFADLDILATGSVVGEVSHDFDRYWASHSAHNATRIIRSGNIGKGLQALGYNDETSRHALLRYRETVEQSPLYQKIQTGRIDWQSVQTRLISDSPAKGLDRDRRKPPIAGRLQDALKQPEKSVYLVSPYFVPTKSGTDALAKLVQDGIDVTVLTNSLQATDVAAVHSGYVKYRKPLLKAGIKLYELQPNHAVPATKDKGLTGSSVTSLHAKTFIVDGKRIFIGSFNLDPRSARLNTEMGVVIESPKIAEQMERTLADTTPEYAYRVTLDKHNRLQWHDPATRKTYPNEPEAKLWKRIAAKILSLLPIEGLL

SEQ ID NO: 2010 - protein, 508 aa, Neisseria
MKTRSLISLLCLLLCSCSSWLPPLEERTESRHFNTSKPVRLDNILQIRHTPHTNGLSDIYLLNDPHEAFAARAALIESAEHSLDLQYYIWRNDISGRLLFNLVYLAAERGVRVRLLLDDNNTRGLDDLLLALDSHPNIEVRLFNPFVLRKWRALGYLTDFPRLNRRMHNKSFTADNRATILGGRNIGDEYFKVGEDTVFADLDILATGSVVGEVSHDFDRYWASHSAHNATRIIRSGDIGKGLQALGYNDETSRHALLRYRETVEQSPLYQKIQTGCIDWQSVRTRLISDDPAKGLDRDRRKPPIAGRLQDALKQPEKSVYLVSPYFVPTKSGTDALAKLVQDGIDVTVLTNSLQATDVAAVHSGYVKYRKPLLKAGIKLYELQPNHAVPATKDKGLTGSSVTSLHAKTFIVDGKRIFIGSFNLDPRSARLNTEMGVVIESPKIAEQMERTLADTTPAYAYRVTLDRHNRLQWHDPATRKTYPNEPEAKLWKRIAAKILSLLPIEGLL

SEQ ID NO: 2011 - protein, 508 aa, Neisseria
MKTRSLISLLCLLLCSCSSWLPPLEERTESRHFNTSKPVRLDNILQIRHTPHTNGLSDIYLLNDPHEAFAARAALIESAEHSLDLQYYIWRNDISGRLLFNLVYLAAERGVRVRLLLDDNNTRGLDDLLLALDSHPNIEVRLFNPFVLRKWRALGYLTDFPRLNRRMHNKSFTADNRATILGGRNIGDEYFKVGEDTVFADLDILATGSVVGEVSHDFDRYWASHSAHNATRIIRSGNIGKGLQALGYNDETSRHALLRYRETVEQSPLYQKIQTGRIDWQSVQTRLISDDPAKGLDRDRRKPPIAGRLQDALKQPEKSVYLVSPYFVPTKSGTDALAKLVQDGIDVTVLTNSLQATDVAAVHSGYVKYRKPLLKAGIKLYELQPNHAVPATKDKGLTGSSVTSLHAKTFIVDGKRIFIGSFNLDPRSARLNTEMGVVIESPKIAEQMERTLADTSPEYAYRVTLDRHNRLQWHDPATRKTYPNEPEAKLWKRIAAKILSLLPIESLL

SEQ ID NO: 2012 - protein, 792 aa, Neisseria
MNKNIKSLNLREKDPFLSREKQRYEHPLPSREWIIELLERKGVPSKIESLARELSITEDEYVFFERRLKAMARDGQVLINRRGAVCAADKLDLVKCRVEAHKDGFGFAVPLMPMDEGDFVLYERQMRGVMHGDTVTVRPAGMDRRGRREGTFLDIVERAQSKVVGRFYMDRGVAILEPEDKRLNQSIVLEPDGVARFKPESGQVIVGKIEVYPEQNRPAVAKIIEVLGDYADSGMEIEIAVRKHHLPHRFSEACAKSAKKIPDHVRKSDLKGRVDLCDLPLVTIDGETARDFDDAVFAEKVGRNYRLVVAIADVSHYVRPDDAIDADAQERSTSVYFPRRMIPMLPENLSNGICSLNPDVERLCMVCDMVVTYAGNIKEYRFYPAVMRSHARLTYNQVWKWLSDGIGNPHKAQIDTLYKLFKILQKKRLARGAVEFESVETQMIFDDNGKIEKIVPVVRNDAHKLIEECMLAANVCAADFLLKNKHTALFRNHLGPTPEKLATLREQLGLLGLQLGGGDNPSPKDYAALAEQFKGRPDAELLQVMMLRSMQQAVYEPHCEGHFGLAYEAYAHFTSPIRRYPDLTVHRAIKAVLNRKTYTPNKSWQALGVHTSFCERRADDAGRDVENWLKTYYMRDKVGEIFEGKISRGVANFGIFVTLDDIHIDGLVHISDLGEDYFNFRPEIMAIEGERSGIRFNMGDRVAVRVARADLDDGKIDFVLIAGESGRRRKVKLSASAKPAGAAGKGKSKTTAEKKTARCGKVRGRGVPAVAESGKKAKKPVPIKVKKRKGKS

SEQ ID NO: 2013 - protein, 641 aa, Neisseria
TVLDIVERAQSKVVGRFYMDRGVAILEPEDKRLNQSIVLEPDGVARFKPESGQVIVGEIEVYPEQNRPAVAKIIEVLGDYADSGMEIEIAVRKHHLPHQFSEACAKAAKKIPVHVRKSDLKGRVDLRDLPLVTIDGETARDFDDAVFAEKVGRNYRLVVAIADVSHYVRPDDVIDADAQERSTSVYFPRRVIPMLPENLSNGICSLNPDVERLCMVCDMVVTYAGNIKEYRFYPAVMRSHARLTYNQVWKWISDGIDHPYKAQIDTLYKLFKILQKKRFERGAVEFESVETQMIFDDNGKIEKIVPVVRNDAHKLIEECMLAANVCAADFLLKNKHTALFRNHLGPTPEKLATLREQLGLLGLQLGGGDNPSPKDYAALVEQFKGRPDAELLQVMMLRSMQQAVYEPHCDGHFGLAYEAYAHFTSPIRRYPDLTVHRAIKAVLNQQTYTPKKSWQALGVHTSFCERRADDASRDVENWLKTYYMRDKVGEVFEGKISGMTSFGIFVTLDGIHIDGLVHISDLGEDYFNFRPEIMAIEGERSGIRFNMGDRVAVRVARADLDDGKIDFVLIAGGSGRGRKVKSSASAKPAGTAGKGKPKTAAEKKTARGGKVRGRGASAAAESRKKAKKPVPIKVKKRKGKS

SEQ ID NO: 2014 - protein, 791 aa, Neisseria
  VARIANT (1)...(791): Xaa = Any Amino Acid
MNKNIKSLNLREKDPFLSREKQRYEHPLPSREWIIELLERKGVPSKIEALVRELSIKEEEYEFFERRLKAMARDGQVLINRRGAVCAADKLDLVKCRVKAHKDRFGFAVPLTPAKDGDFVLYERQMRGIMHGDIVTVRPAGMDGRGRREGTVLDIVERAQSKVVGRFXMDRGVAILEPEDKRLNQSIVLEPDGVARFKPESGQVIVGEIEVYPEQNRPAVAKIIEVLGDYADSGMEIEIAVRKHHLPHQFSEACAKAAKKIPDHVRKSDLKGRVDLRDLPLVTIDGETARDFDDAVFAEKIGRNYRLVVAIADVSHYVRPDDAIDTDAQERSTSVYFPRRVIPMLPENLSNGICSLNPHVERLCVVCDMVITYAGNIKEYRFYPAVMRSHARLTYNQVWKWLSGGIEHPFKTQIDTLYKLFKILQKKRFERGAVEFDSIETQMLFDDNGKIEKIVPVVRNDAHKLIEECMLAANVCAADFLLKNKHTALFRNHLGPTPEKLAALREQLGLLGLQLGGGDNPSPKDYAALAGQFKGRPDAELLQVMMLRSMQQAVYEPHCDGHFGLAYEAYAHFTSPIRRYPDLTVHRAIKAVLNQQTYTPKKSWQALGVHTSFCERRADDASRDVENWLKTYYMRDKVGEVFEGKISGMTSFGIFVTLDGIHIDGLVHISDLGEDYFNFRPEIMAIEGERSGIRFNMGDRVAVRVARADLDDGKIDFVLIAGGSGRGRKVKSSASAKPAGTAGKGKPKTAAEKKTARGGKVRGRGASAAAESRKKAKKPVPIKVKKRKGKS

SEQ ID NO: 2015 - protein, 459 aa, Neisseria
MTPFTLKKTVLLLGTAFAAASVHASGYHFGTQSVNAQSTANAADASTIFYNPAGLTKLDSSQISVNANIVLPSIHYEADSATDFTGLPVQGSKNGKITKTTVAPHIYGAYKVNDNLTVGLGVYVPFGSATEYEKDSVLRHNINKLGLTSIAVEPVAAWKLNERHSFGAGIIAQHNSAELRKYADGIPKKAQMLQATPSNPTAAAQIKADGHADVKGSDWGVGYQLAWMWDINDRARVGVNYRSKVSHTLKGDAEWAADGAAAKQQWNDNMLTPLGYTANEKASVKIVTPESLSVHGMYKVSDKADLFGDVTWTRHSRFNKAELFFEKEKNIANGKKSDRTTITPNWRNTYKVGLGGSYQISEPLQLRVGIAFDKPPVRNADYRMNSLPDGNRIWFSAGMKYHIGKNHVVDAAYTHIHINDTSYRTAKASGNDVDSKGASCARFKNHADIIGLQYTYKFK

SEQ ID NO: 2016 - protein, 466 aa, Neisseria
MTPSALKKTVLLLGTAFAAASVHASGYHFGTQSVNAQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADIIGLQYTYKFK

SEQ ID NO: 2017 - protein, 464 aa, Neisseria
MTPSALKKTVLLLGTAFAAASAQASGYHFGTQSVNAQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNERHSFGAGIIAQHTSAELRKYADWGIMEKAKALKETPPNPTKAAQIKADGHADVKGSDWGFGYQLAWMWDINDRARVGVNYRSKVSHTLKGDAEWAADDAMAKQLWDANKLALLGYTPSEKARVKIVTPESLSVHGMYKVSDKADLFGDVTWTRHSRFDKAELVFEKEKTIVNGKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADIIGLQYTYKFK

SEQ ID NO: 2018 - protein, 619 aa, Neisseria
MFRAQLGSNTRSTKIGDDADFSFSDKPKPGTSHYFSSGKTDQNSSEYGYDEINIQGKNYNSGILAVDNMPVVKKYITEKYGADLKQAVKSQLQDLYKTRPEAWAENKKRTEEAYIAQFGTKFSTLKQTMPDLINKLVEDSVLTPHSNTSQTSLNNIFNKKLHVKIENKSHVAGQVLELTKMTLKDSLWEPRRHSDIHTLETSDNARIRLNTKDEKLTVHKDYAGGADFLFGYDVRESDEPALTFEDKVSGQSGVVLERRPENLKTLDGRKLIAAKTADSGSFAFKQNYRQGLYELLLKQCEGGFCLGVQRLAIPEAEAVLYAQQAYAANTLFGLRAADRGDDVYAADPSRQKLWLRFIGGRSHQNIRGGAAADGWRKGVQIGGEVFVRQNEGSRLAIGVMGGRAGQHASVNGKGGAAGSDLYGYGGGVYAAWHQLRDKQTGAYLDGWLQYQRFKHRINDENRAERYKTKGWTASVEGGYNALVAEGIVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMSARIGYGKRTDGDKEAALSLKWLF

SEQ ID NO: 2019 - protein, 619 aa, Neisseria; identical to SEQ ID NO: 258

SEQ ID NO: 2020 - protein, 233 aa, Neisseria
MFRRHRHLKNMQIKKIMKWLPVALSLLGALGYTGYDSEAVRTAVAVLDVLGTAGDVGFDAPVRRRASAKSGHSYTGTVSKVYDGDTLHVIDGDGAKHKIRMAYIDAPEMKQAYGTRSRDNLRAAAEGRKVSVRVFETDRYQREVAQVSAGKTDLNLMQVQDGAAWHYKSYAKEQQDKADFADYADAQIQAERERKGLWKAKNPQAPWAYRRAGRSGGGNKDWMDSVGEWLGIW

SEQ ID NO: 2021 - protein, 233 aa, Neisseria
MFRRHRHLKNMQIKKIMKWLPVALSLLGALGYTGYGSEAVRTAVAVLDVLGAAGDAGSDAPARRRASAKSGHRYTGTVSKVYDGDTLHVIDGDGAKHKIRMAYIDAPEMKQAYGTRSRDNLRAAAEGRKVSVRVFDTDRYQREVAQVSVGKTDLNLMQVQDGAAWHYKSYAKEQQDKADFADYADAQIQAERERKGLWKAKNPQAPWAYRRAGRSGGGNKDWMDAVGEWLGIW

SEQ ID NO: 2022 - protein, 233 aa, Neisseria; identical to SEQ ID NO: 2021

SEQ ID NO: 2023 - protein, 248 aa, Neisseria
LKVVLGSFQGPLDLLLYLIRKQNIDVLDIPMVEITGQYLHYIAQMEAYQFDLAAEYLLMAAMLIEIKSRLLLPRTEAVEDEEADPRAELVRRLLAYEQMKLAAQGLDALPRAGRDFAWAYLPLEIAAETKLPEVYIADLMQAWLGILSRAKHTRSHEVIQETLSVRAQMTAILRRLNEHGICRFHALFNPEQGAAYVIVNFIALLELAKEGLVGIVQEDGFGEIRISLNHEGAHSDGIFGTRGGRDVF

SEQ ID NO: 2024 - protein, 248 aa, Neisseria
LKVVLGSFQGPLDLLLYLIRKQNIDVLDIPMVKITEQYLHYIAQIETYQFDLAAEYLLMAAMLIEIKSRLLLPRTETVEDEEADPRAELVRRLLAYEQMKLAAQGLDALPRAGRDFAWAYLPLEIAVEAKLPEVYITDLTQAWLGILSRAKHTRSHEVIKETISVRAQMTAILRRLNGHGICRFHDLFNPKQGAAYVVVNFIALLELAKEGLVRIVQEDGFGEIRISLNHEGAHSDGISGTRGGRDVF

SEQ ID NO: 2025 - protein, 248 aa, Neisseria
LKVVLSSFQGPLDLLLYLIRKQNIDVLDIPMVKITEQYLHYIAQIETYQFDLAAEYLLMAAMLIEIKSRLLLPRTETVEDEEADPRAELVRRLLAYEQMKLAAQGLDALPRAGRDFAWAYLPLEIAVEAKLPEVYITDLTQAWLSILSRAKHTRSHEVIKETISVRAQMTAILRRLNKHGICRFHDLFNPEQGAAYVVVNFIALLELAKEGLVGIVQEVGFGEIRISLNHEGAHSDGISGTRGGRDVF

SEQ ID NO: 2026 - protein, 200 aa, Neisseria
MNRRTFLLGAGALLLTACGRKSARTHAKIPEGSTVLALGDSLTFGYGANPGESYPAQLQKLTGWNIVNGGVSGDTSAQALSRLPALLARKPKLVIVGIGGNDFLRKVPEEQTRANIAKIIETVQKENIPAVLVGVPHITLGALFGHLSDHPLYEDLSEEYGIPLFGGAWAEILGNNNLKSDQIHANGKGYRKFAENLNQF

SEQ ID NO: 2027 - protein, 207 aa, Neisseria
MNRRTFLLGAGALLLTACGRKSARTHAKIPEGSTVLALGDSLTFGYGANPGESYPAQLQKLTGWNIVNGGVSGDTSAQALSRLPALLARKPKLVIVGIGGNDFLRKVPKEQTRANIAKIIETVQKENIPAVLVGVPHITLGALFGHLSDHPLYEDLSEEYGIPLFGGAWAEILGDNNLKSDQIHANGKGYRKFAEDLNQFLRKQGFR

SEQ ID NO: 2028 - protein, 207 aa, Neisseria; identical to SEQ ID NO: 2027

SEQ ID NO: 2029 - protein, 351 aa, Neisseria
MMNTPHPRPKIAVIGAGWAGLSAAVTLARHADVTLFEAGRQAGGRARTLAGNTDGFGFLDNGQHILLGAYRGVLRLMKTIGSDPRAAFLRVPLHWHMHGGLQFRALPLPAPLHILGGVLLARRVPSAFKAKLLADMSDLQKSARLGQPDTTVAQWLKQRNVPRAAVMQFWQPLVWGALNTPLETASLRVLCNVLSDGVLTKKSGSDYLLPKQDLGAIVAEPALAELQRLGADIRLETRVCRLNTLPDGKVLVNGEAFDAAILATAPYHAAALLPEGTPEHVQTAYQNLRYHAITTVYLRYAEPVRLPAPLTGIADGTAQWLLCPGQAPDCPQNEVSAVISVSDRVGAFANR

SEQ ID NO: 2030 - protein, 437 aa, Neisseria
MMNTPHPRPKIAVIGAGWAGLSAAVTLARHADVTLFEAGRQAGGRARTLAGNTDGFGFLDNGQHILLGAYRGVLRLMKTIGSDPRAAFLRVPLHWHMHGGLQFRALPLPAPLHILGGVLLARRAPTAFKAKLLADMSDLQKSARLGQPDTTVAQWLKQRNVPRAAVMQFWQPLVWGALNTPLETASLRVLCNVLSDGVLTKKSGSDYLLPKQDLGAIVAEPALADLQRLGADIRLETRVCRLNTLPDGKVLVNGEAFDAAVPATAPYHAAALLPEGTPEHVQTAYQNLRYHAITTVYLRYAEPVRLPAPLTGLADGTVQWLLCRGRLGLPENEVSAVISVSDRVGAFANRAWADKAHADLKRILPHLGEPEAVRVITEKRATTAADAPPPDLSWLHRHRIFPAGDYLHPDYPATLEAAVQSGFASAEACLQSLSDAV

SEQ ID NO: 2031 - protein, 437 aa, Neisseria
MMNTPHPRPKIAVIGAGWAGLSAAVTLARHADVTLFEAGRQAGGRARALAGNTDGFGFLDNGQHILLGAYRGVLRLMKTIGSDPHAAFLRVPLHWHMHGGLQFRALPLPAPLHILGGVLLARRVPSAFKAKLLADMSDLQKSARLGQPDTTVAQWLKQRNVPRAAVMQFWQPLVWGALNTPLETASLRVLCNVLSDGVLTKKSGSDYLLPKQDLGAIVAEPALAELQRLGADIRLETRICRLNTLPDGKVLVNGEPFDAAVPATAPYHAAALLPEGTPEHVQTAYQNLRYHAITTVYLRYAEPVRLPAPLTGLADGTVQWLLCRGRLGLPENEVSAVISVSDRVGAFANRAWADKVHADLKRILPHLGEPEAVRVITEKRATTAADAPPPDLSWLHRHRIFPAGDYLHPDYPATLEAAVQSGFASAEACLQSLSDAV

SEQ ID NO: 2032 - protein, 200 aa, Neisseria
MNMKKLISAICVSIVLSACNQQSKTAQAEEPVQSIQAADCTAPMDITVEQYLINLEQAFKTQNVSTKIHNKNIVKTDCGYDLTLVMDFGAIALKLDEQQKIRAISVGYILKTDGEKGQNLVNNAINGLHSIQAVLSLTTTDKLGESEAGKQLFTALTEVVKESNQTGATAQKDVPADGILYSVVFEKETNTIAIIGRKQP

SEQ ID NO: 2033 - protein, 152 aa, Neisseria; identical to SEQ ID NO: 1096

SEQ ID NO: 2034 - protein, 152 aa, Neisseria; identical to SEQ ID NO: 1095

SEQ ID NO: 2035 - protein, 152 aa, Neisseria; identical to SEQ ID NO: 1097
  VARIANT (1)...(152): Xaa = Any Amino Acid

SEQ ID NO: 2036 - protein, 199 aa, Neisseria; identical to SEQ ID NO: 1247

SEQ ID NO: 2037 - protein, 316 aa, Neisseria; identical to SEQ ID NO: 1246

SEQ ID NO: 2038 - protein, 315 aa, Neisseria; identical to SEQ ID NO: 1248

SEQ ID NO: 2039 - protein, 315 aa, Neisseria; identical to SEQ ID NO: 1250

SEQ ID NO: 2040 - protein, 315 aa, Neisseria; identical to SEQ ID NO: 1249

SEQ ID NO: 2041 - protein, 315 aa, Neisseria; identical to SEQ ID NO: 1248

SEQ ID NO: 2042 - protein, 222 aa, Neisseria; identical to SEQ ID NO: 1392

SEQ ID NO: 2043 - protein, 215 aa, Neisseria; identical to SEQ ID NO: 1391

SEQ ID NO: 2044 - protein, 272 aa, Neisseria; identical to SEQ ID NO: 1393

SEQ ID NO: 2045 - protein, 272 aa, Neisseria; identical to SEQ ID NO: 1395

SEQ ID NO: 2046 - protein, 272 aa, Neisseria; identical to SEQ ID NO: 1394

SEQ ID NO: 2047 - protein, 272 aa, Neisseria; identical to SEQ ID NO: 1393

SEQ ID NO: 2048 - protein, 441 aa, Neisseria; identical to SEQ ID NO: 1918

SEQ ID NO: 2049 - protein, 441 aa, Neisseria; identical to SEQ ID NO: 1917

SEQ ID NO: 2050 - protein, 441 aa, Neisseria; identical to SEQ ID NO: 1919

SEQ ID NO: 2051 - protein, 366 aa, Neisseria; identical to SEQ ID NO: 741
  VARIANT (1)...(366): Xaa = Any Amino Acid

SEQ ID NO: 2052 - protein, 366 aa, Neisseria; identical to SEQ ID NO: 740

SEQ ID NO: 2053 - protein, 366 aa, Neisseria; identical to SEQ ID NO: 742

SEQ ID NO: 2054 - protein, 366 aa, Neisseria; identical to SEQ ID NO: 743
  VARIANT (1)...(366): Xaa = Any Amino Acid

SEQ ID NO: 2055 - protein, 366 aa, Neisseria; identical to SEQ ID NO: 742

SEQ ID NO: 2056 - protein, 426 aa, Neisseria
  VARIANT (1)...(426): Xaa = Any Amino Acid
NTVEPLTGITERVGRIWGVVSHLNCVADTPELRAVYNELMPEITVFFTEIGQDIELYNRFKTIKNSPEFDTLSPAQKTKLNHYASEKLREAKYAFSETXVKKYFPVGXVLNGLFAQXKKLYGIGFTEKTVPVWHKDVRYXELQQNGEXIGGVYMDLYAREGKRGGAWMNDYKGRRRFSDGTLQLPTAYLVCNFAPPVGGREARLSHDEILILFHETGHGLHHLLTQVDELGVSGINGVXWDAVELPSQFMENFVWEYNVLAQXSAHEETGVPLPKELXDKXLAAKNFQXGMFXVRQXEFALFDMMIYSEDDEGRLKNWQQVLDSVRKKVAVIQPPEYNRFALSFGHIFAGGYSAAXYSYAWAEVLSADAYAAFEESDDVAATGKRFWQEILAVGXSRSGAESFKAFRGREPSIDALLRHSGFDNAV

SEQ ID NO: 2057 - protein, 678 aa, Neisseria; identical to SEQ ID NO: 763

SEQ ID NO: 2058 - protein, 678 aa, Neisseria; identical to SEQ ID NO: 765

SEQ ID NO: 2059 - protein, 678 aa, Neisseria; identical to SEQ ID NO: 767

SEQ ID NO: 2060 - protein, 491 aa, Neisseria; identical to SEQ ID NO: 766

SEQ ID NO: 2061 - protein, 678 aa, Neisseria; identical to SEQ ID NO: 765

SEQ ID NO: 2062 - protein, 177 aa, Neisseria; identical to SEQ ID NO: 881
  VARIANT (1)...(177): Xaa = Any Amino Acid

SEQ ID NO: 2063 - protein, 177 aa, Neisseria; identical to SEQ ID NO: 880

SEQ ID NO: 2064 - protein, 177 aa, Neisseria; identical to SEQ ID NO: 882

SEQ ID NO: 2065 - protein, 488 aa, Neisseria; identical to SEQ ID NO: 1123

SEQ ID NO: 2066 - protein, 429 aa, Neisseria; identical to SEQ ID NO: 1122

SEQ ID NO: 2067 - protein, 497 aa, Neisseria; identical to SEQ ID NO: 1124

SEQ ID NO: 2068 - protein, 320 aa, Neisseria; identical to SEQ ID NO: 71

SEQ ID NO: 2069 - protein, 320 aa, Neisseria; identical to SEQ ID NO: 73

SEQ ID NO: 2070 - protein, 320 aa, Neisseria; identical to SEQ ID NO: 72

SEQ ID NO: 2071 - protein, 222 aa, Neisseria
MDSFFKPAVWAVLWLMFAVRPALADELTNLLSSREQILRQFAEDEQPVLPVNRAPARRAGNADELIGSAMGLNEQPVLPVNRAPARRAGNADELIGSAMGLLGIAYRYGGTSVSTGFDCSGFMQHIFKRAMGINLPRTSAEQARMGAPVARSELQPGDMVFFRTLGGSRISHVGLYIGNNRFIHAPRTGKNIEITSLSHKYWSGKYAFARRVKKNDPSRFLN

SEQ ID NO: 2072 - protein, 280 aa, Neisseria
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRVPARRAGNADELIGNAMGLNEQPVLPVNRAPARRAGNADELIGNAMGLLGIAYRYGGTSISTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 2073 - protein, 251 aa, Neisseria
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLLGIAYRYGGTSISTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 2074 - protein, 251 aa, Neisseria; identical to SEQ ID NO: 923

SEQ ID NO: 2075 - protein, 251 aa, Neisseria
MDSFFKPAVWAVLWLMFAVRLALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 2076 - protein, 251 aa, Neisseria; identical to SEQ ID NO: 923

SEQ ID NO: 2077 - protein, 251 aa, Neisseria
MDSFFKPAVWAVLWLMFAVRPALADELTNLLSSREQILRQFAEDEQPVLPINRAPARRAGNADELIGSAMGLNEQPVLPVNRVPARRAGNADELIGSAMGLNEQPVLPVNRAPARRAGNADELIGNAMGLLGIAYRYGGTSISTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 2078 - protein, 251 aa, Neisseria; identical to SEQ ID NO: 923

SEQ ID NO: 2079 - protein, 251 aa, Neisseria; identical to SEQ ID NO: 923

SEQ ID NO: 2080 - protein, 251 aa, Neisseria; identical to SEQ ID NO: 2077

SEQ ID NO: 2081 - protein, 251 aa, Neisseria; identical to SEQ ID NO: 2073

SEQ ID NO: 2082 - protein, 251 aa, Neisseria; identical to SEQ ID NO: 923

SEQ ID NO: 2083 - protein, 280 aa, Neisseria
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 2084 - protein, 251 aa, Neisseria; identical to SEQ ID NO: 2073

SEQ ID NO: 2085 - protein, 251 aa, Neisseria
MDSFFKPAVWAVLWLMFAVRPALADELTNLLSSREQILRQFAEDEQPVLPVNRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFIQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 2086 - protein, 251 aa, Neisseria; identical to SEQ ID NO: 923

SEQ ID NO: 2087 - protein, 222 aa, Neisseria
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 2088 - protein, 251 aa, Neisseria; identical to SEQ ID NO: 923

SEQ ID NO: 2089 - protein, 251 aa, Neisseria; identical to SEQ ID NO: 923

SEQ ID NO: 2090 - protein, 251 aa, Neisseria; identical to SEQ ID NO: 923

SEQ ID NO: 2091 - protein, 251 aa, Neisseria; identical to SEQ ID NO: 923

SEQ ID NO: 2092 - protein, 280 aa, Neisseria
MDSFFKPAVWAVLWLMFAVRPALADELTNLLSSREQILRQFAEDEQPVLPINRAPARRAGNADELIGSAMGLNEQPVLPINRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 2093 - protein, 251 aa, Neisseria; identical to SEQ ID NO: 923

SEQ ID NO: 2094 - protein, 251 aa, Neisseria; identical to SEQ ID NO: 2073

SEQ ID NO: 2095 - protein, 251 aa, Neisseria; identical to SEQ ID NO: 2073

SEQ ID NO: 2096 - protein, 251 aa, Neisseria; identical to SEQ ID NO: 2073

SEQ ID NO: 2097 - protein, 251 aa, Neisseria; identical to SEQ ID NO: 2073

SEQ ID NO: 2098 - protein, 251 aa, Neisseria; identical to SEQ ID NO: 2073

SEQ ID NO: 2099 - protein, 251 aa, Neisseria; identical to SEQ ID NO: 923

SEQ ID NO: 2100 - protein, 251 aa, Neisseria; identical to SEQ ID NO: 923

SEQ ID NO: 2101 - protein, 251 aa, Neisseria; identical to SEQ ID NO: 923

SEQ ID NO: 2102 - protein, 222 aa, Neisseria; identical to SEQ ID NO: 2071

SEQ ID NO: 2103 - protein, 222 aa, Neisseria
MDSFFKPAVWAVLWLMFAVRSALADELTNLLSSREQILRQFAEDEQPVLPVNRAPARRAGNADELIGSAMGLNEQPVLPVNRAPARRAGNADELIGSAMGLLGIAYRYGGTSVSTGFDCSGFMQHIFKRAMGINLPRTSAEQARMGAPVARSELQPGDMVFFRTLGGSRISHVGLYIGNNRFIHAPRTGKNIEITSLSHKYWSGKYAFARRIKKNDPSRFLN

SEQ ID NO: 2104 - protein, 251 aa, Neisseria; identical to SEQ ID NO: 2073

SEQ ID NO: 2105 - protein, 215 aa, Neisseria; identical to SEQ ID NO: 957

SEQ ID NO: 2106 - protein, 215 aa, Neisseria
MKPLILGLAAVLALSACQVQKAPDFDYTSFKESKPASILVVPPLNESPDVNGTWGVLASTAAPLSEAGYYVFPAAVVEETFKENGLTNAADIHAVRPEKLHQIFGNDAVLYITVTEYGTSYQILDSVTTVSAKARLVDSRNGKELWSGSASIREGSNNSNSGLLGALVSAVVNQIANNLTDRGYQVSKTAAYNLLSPYSHNGILKGPRFVEEQPK

SEQ ID NO: 2107 - protein, 215 aa, Neisseria; identical to SEQ ID NO: 958

SEQ ID NO: 2108 - protein, 215 aa, Neisseria; identical to SEQ ID NO: 958

SEQ ID NO: 2109 - protein, 215 aa, Neisseria; identical to SEQ ID NO: 958

SEQ ID NO: 2110 - protein, 215 aa, Neisseria; identical to SEQ ID NO: 2106

SEQ ID NO: 2111 - protein, 215 aa, Neisseria; identical to SEQ ID NO: 958

SEQ ID NO: 2112 - protein, 215 aa, Neisseria; identical to SEQ ID NO: 2106

SEQ ID NO: 2113 - protein, 215 aa, Neisseria
MKPLILGLAAALVLSACQVQKAPDFDYTSFKESKPASILVVPPLNESPDVNGTWGMLASTAEPLSEAGYYVFPAAVVEETFKQNGLTNAADIHAVQPEKLHQIFGNDAVLYITITEYGTSYQILDSVTTVSARARLVDSRNGKVLWSGSASIREGSNNSNSGLLGALVSAVVNQIANSLTDRGYQVSKTAAYNLLSPYSHNGILKGPRFVEEQPK

SEQ ID NO: 2114 - protein, 215 aa, Neisseria; identical to SEQ ID NO: 958

SEQ ID NO: 2115 - protein, 215 aa, Neisseria; identical to SEQ ID NO: 958

SEQ ID NO: 2116 - protein, 215 aa, Neisseria; identical to SEQ ID NO: 958

SEQ ID NO: 2117 - protein, 215 aa, Neisseria
MKPLILGLAAVLALSACQVQKAPDFDYTSFKESKPASILVVPPLNESPDVNGTWGVLASTAAPLSEAGYYVFPAAVVEETFKQNGLTNAADIHAVRPEKLHQIFGNDAVLYITVTEYGTSYQILDSVTTVSAKARLVDSRNGKELWSGSASIREGSNNSNSGLLGALVGAVVNQIANSLTDRGYQVSKTAAYNLLSPYSHNGILKGPRFVEEQPK

SEQ ID NO: 2118 - protein, 215 aa, Neisseria; identical to SEQ ID NO: 958

SEQ ID NO: 2119 - protein, 215 aa, Neisseria; identical to SEQ ID NO: 958

SEQ ID NO: 2120 - protein, 215 aa, Neisseria; identical to SEQ ID NO: 958

SEQ ID NO: 2121 - protein, 215 aa, Neisseria; identical to SEQ ID NO: 2117

SEQ ID NO: 2122 - protein, 215 aa, Neisseria; identical to SEQ ID NO: 958

SEQ ID NO: 2123 - protein, 215 aa, Neisseria; identical to SEQ ID NO: 958

SEQ ID NO: 2124 - protein, 215 aa, Neisseria; identical to SEQ ID NO: 958

SEQ ID NO: 2125 - protein, 215 aa, Neisseria; identical to SEQ ID NO: 958

SEQ ID NO: 2126 - protein, 215 aa, Neisseria; identical to SEQ ID NO: 958

SEQ ID NO: 2127 - protein, 215 aa, Neisseria
MKPLILGLAAVLALSACQVQKAPDFDYTSFKESKPASILVVPPLNESPDVNGTWGMLASTAAPLSEAGYYVFPAAVVEETFKQNGLTNAADIHAVRPEKLHQIFGNDAVLYITVTEYGTSYQILDSVTTVSAKARLVDSRNGKELWSGSASIREGSNNSNSGLLGALVGAVVNQIANSLTDRGYQVSKTAAYNLLSPYSHNGILKGPRFVEEQPK

SEQ ID NO: 2128 - protein, 215 aa, Neisseria; identical to SEQ ID NO: 958

SEQ ID NO: 2129 - protein, 215 aa, Neisseria; identical to SEQ ID NO: 958

SEQ ID NO: 2130 - protein, 215 aa, Neisseria; identical to SEQ ID NO: 958

SEQ ID NO: 2131 - protein, 215 aa, Neisseria
MKPLILGLAAVLALSACQVQKAPDFDYTAFKESKPASILVVPPLNESPDVNGTWGMLASTAEPLSEAGYYVFPAAVVEETFKQNGLTNAADIHAVRPEKLHQIFGNDAVLYITITEYGTSYQILDSVTTVSARARLVDSRNGKVLWSGSASIREGSNNSNSGLLGALVGAVVNQIANSLTDRGYQVSKAAAYDLLSPYSHNGILKGPRFVEEQPK

SEQ ID NO: 2132 - protein, 215 aa, Neisseria; identical to SEQ ID NO: 957

SEQ ID NO: 2133 - protein, 215 aa, Neisseria; identical to SEQ ID NO: 957

SEQ ID NO: 2134 - protein, 215 aa, Neisseria; identical to SEQ ID NO: 958

SEQ ID NO: 2135 - protein, 492 aa, Neisseria
MFKRSVIAMACIFALSACGGGGGGSPDVKSADTLSKPAAPVVSEKETEAKEDAPQAGSQGQGAPSAQGGQDMAAVSEENTGNGGAAATDKPKNEDEGAQNDMPQNAADTDSLTPNHTPASNMPAGNMENQAPDAGESEQPANQPDMANTADGMQGDDPSAGGENAGNTAAQGTNQAENNQTAGSQNPASSTNPSATNSGGDFGRTNVGNSVVIDGPSQNITLTHCKGDSCSGNNFLDEEVQLKSEFEKLSDADKISNYKKDGKNDGKNDKFVGLVADSVQMKGINQYIIFYKPKPTSFARFRRSARSRRSLPAEMPLIPVNQADTLIVDGEAVSLTGHSGNIFAPEGNYRYLTYGAEKLPGGSYALRVQGEPSKGEMLAGTAVYNGEVLHFHTENGRPSPSRGRFAAKVDFGSKSVDGIIDSGDGLHMGTQKFKAAIDGNGFKGTWTENGGGDVSGKFYGPAGEEVAGKYSYRPTDAEKGGFGVFAGKKEQD

SEQ ID NO: 2136 - protein, 492 aa, Neisseria; identical to SEQ ID NO: 2135

SEQ ID NO: 2137 - protein, 488 aa, Neisseria; identical to SEQ ID NO: 1123

SEQ ID NO: 2138 - protein, 497 aa, Neisseria; identical to SEQ ID NO: 1124

SEQ ID NO: 2139 - protein, 429 aa, Neisseria; identical to SEQ ID NO: 1122

SEQ ID NO: 2140 - protein, 488 aa, Neisseria; identical to SEQ ID NO: 1123

SEQ ID NO: 2141 - protein, 315 aa, Neisseria; identical to SEQ ID NO: 1249

SEQ ID NO: 2142 - protein, 315 aa, Neisseria; identical to SEQ ID NO: 1248

SEQ ID NO: 2143 - protein, 315 aa, Neisseria; identical to SEQ ID NO: 1250

SEQ ID NO: 2144 - protein, 315 aa, Neisseria
MEFFIILLVAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 2145 - protein, 315 aa, Neisseria; identical to SEQ ID NO: 2144

SEQ ID NO: 2146 - protein, 315 aa, Neisseria; identical to SEQ ID NO: 2144

SEQ ID NO: 2147 - protein, 315 aa, Neisseria; identical to SEQ ID NO: 2144

SEQ ID NO: 2148 - protein, 315 aa, Neisseria
MEFFIILLVAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVFSALDEAAGAWGVKVLRYEIKDLVPPQEILRSMQAQITAERKKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 2149 - protein, 315 aa, Neisseria; identical to SEQ ID NO: 1250

SEQ ID NO: 2150 - protein, 315 aa, Neisseria
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 2151 - protein, 315 aa, Neisseria; identical to SEQ ID NO: 1250

SEQ ID NO: 2152 - protein, 315 aa, Neisseria; identical to SEQ ID NO: 1250

SEQ ID NO: 2153 - protein, 315 aa, Neisseria; identical to SEQ ID NO: 1250

SEQ ID NO: 2154 - protein, 315 aa, Neisseria
MEFFIILLVAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSMISAGMKIIDSSKTAK

SEQ ID NO: 2155 - protein, 315 aa, Neisseria; identical to SEQ ID NO: 1250

SEQ ID NO: 2156 - protein, 315 aa, Neisseria
MEFFIILLAAVVVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRSMQAQITAEREKRARIAESEGRKIEQINLASGQREAKIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 2157 - protein, 315 aa, Neisseria
MEFFIILLAAVVVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 2158 - protein, 315 aa, Neisseria; identical to SEQ ID NO: 1250

SEQ ID NO: 2159 - protein, 315 aa, Neisseria; identical to SEQ ID NO: 2150

SEQ ID NO: 2160 - protein, 315 aa, Neisseria
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSIVVSALDEAAGAWGVKVLRYEIKDLVPPQEILRSMQAQITAEREKRARIAESEGRKIEQINLASGQREPEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSNKTAK

SEQ ID NO: 2161 - protein, 315 aa, Neisseria; identical to SEQ ID NO: 1249

SEQ ID NO: 2162 - protein, 315 aa, Neisseria; identical to SEQ ID NO: 2150

SEQ ID NO: 2163 - protein, 441 aa, Neisseria; identical to SEQ ID NO: 1917

SEQ ID NO: 2164 - protein, 441 aa, Neisseria; identical to SEQ ID NO: 1919

SEQ ID NO: 2165 - protein, 441 aa, Neisseria; identical to SEQ ID NO: 1918

SEQ ID NO: 2166 - protein, 441 aa, Neisseria; identical to SEQ ID NO: 1918

SEQ ID NO: 2167 - protein, 441 aa, Neisseria; identical to SEQ ID NO: 1918

SEQ ID NO: 2168 - protein, 441 aa, Neisseria
MKKYLFRAALCGIAAAILAACQSKSIQTFPQPDTSVINGPDRPVGIPAPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMQQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2169 - protein, 441 aa, Neisseria
MKKYLFRAALYGIAAAILAACQSKSIQTFPQPDTSVINGPDRPVGIPDPAGTTVGGGGAVYTVVPHLSLPHWAAQDFAKSLQSFRLSCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2170 - protein, 441 aa, Neisseria
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2171 - protein, 441 aa, Neisseria; identical to SEQ ID NO: 1918

SEQ ID NO: 2172 - protein, 441 aa, Neisseria
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2173 - protein, 441 aa, Neisseria
MKKYLFRAALCGIAAAILAACQSKSIQTFPQPDTSVINGPDRPVGIPAPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSGNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2174 - protein, 441 aa, Neisseria; identical to SEQ ID NO: 2173

SEQ ID NO: 2175 - protein, 441 aa, Neisseria
MKKYLFRAALCGIAAAILAACQSKSIQTFPQPDTSVINGPDRPVGIPAPAGTTVGGGGAVYTVVPHLSLPHWAAQDFAKSLQSFRLGCANLKNRQGWQDVCAQAFQTPVHSVQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2176 - protein, 441 aa, Neisseria; identical to SEQ ID NO: 1918

SEQ ID NO: 2177 - protein, 441 aa, Neisseria
MKKYLFRAALYGIAAAILAACQSKSIQTFPQPDTSVINGPDRPVGIPDPAGTTVGGGGAVYTVVPHLSLPHWAEQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2178 - protein, 441 aa, Neisseria
MKKYLFRAALCGIAAAILAACQSKSIQTFPQPDTSVINGPDRPVGIPAPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSRNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2179 - protein, 441 aa, Neisseria
MKKYLFRAALYGIAAAILAACQSKSIQTFPQPDTSVINGPDRPVGIPDLAGTTVGGGGAVYTVVPHLSLPHWAAQDFAKSLQSFRLGCANLKNHQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSGNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2180 - protein, 441 aa, Neisseria
MKKYLFRAALCGIAAAILAACQSKSIQTFPQPDTSVINGPGRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2181 - protein, 441 aa, Neisseria
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2182 - protein, 441 aa, Neisseria; identical to SEQ ID NO: 1918

SEQ ID NO: 2183 - protein, 441 aa, Neisseria; identical to SEQ ID NO: 1918

SEQ ID NO: 2184 - protein, 441 aa, Neisseria; identical to SEQ ID NO: 1918

SEQ ID NO: 2185 - protein, 441 aa, Neisseria; identical to SEQ ID NO: 1918

SEQ ID NO: 2186 - protein, 441 aa, Neisseria; identical to SEQ ID NO: 1919

SEQ ID NO: 2187 - protein, 441 aa, Neisseria
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELAGSSNDGPVGALGTPLMGEYAGAVDRHYITLGAPLFVATAHPVTSKALNRLIMAQDTGSAIKGAVRVDYFWGYGDEAGETAGKMKEPGYVWQLLPNGMKPEYRP

SEQ ID NO: 2188 - protein, 441 aa, Neisseria; identical to SEQ ID NO: 2173

SEQ ID NO: 2189 - protein, 441 aa, Neisseria; identical to SEQ ID NO: 2173

SEQ ID NO: 2190 - protein, 441 aa, Neisseria
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSVQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMQQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2191 - protein, 441 aa, Neisseria
MKKYLFRAALYGISAAILAACQSKSIQTFPQPDTSVINGPDRPAGIPDPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGETAGKMKEPGYVWQLLPNGMKPEYRP

SEQ ID NO: 2192 - protein, 441 aa, Neisseria
MKKYLFRAALCGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2193 - protein, 441 aa, Neisseria
MKKYLFRAALCGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPQRLAEVLGQNPSYIFFRELTGSGNDGPVGALGTPLMGEYAGAVDRHYITLGAPLFVATTHPITRKALNRLIMAQDTGSAIKGAVRVDYFWGYGDEAGELAGKQKTTGYVWQLLPNGMKPEYRP

SEQ ID NO: 2194 - protein, 441 aa, Neisseria
MKKHLFRAALYGIAAAILAACQSKSIQTFPQPDTSIIKGPDRPAGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYVFFRELAGSGNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2195 - protein, 441 aa, Neisseria
MKKHLLRSALYGIAAAILAACQSRSIQTFPQPDTSVINGPDRPAGIPDPAGTTVAGGGAVYTVVPHLSMPHWAAQDFAKSLQSFRLGCANLKNRQGWQDVCAQAFQTPVHSFQAKRFFERYFTPWQVAGNGSLAGTVTGYYEPVLKGDGRRTERARFPIYGIPDDFISVPLPAGLRGGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSGGDGPVGALGTPLMGGYAGAIDRHYITLGAPLFVATAHPVTRKALNRLIMAQDTGSAIKGAVRVDYFWGYGDEAGELAGKQKTTGYVWQLLPNGMKPEYRP

SEQ ID NO: 2196 - protein, 441 aa, Neisseria
MKKHLLRSALYGIAAAILAACQSRSIQTFPQPDTSVINGPDRPAGIPDPAGTTVAGGGAVYTVVPHLSMPHWAAQDFAKSLQSFRLGCANLKNRQGWQDVCAQAFQTPIHSFQAKRFFERYFTPWQVAGNGSLAGTVTGYYEPVLKGDGRRTERARFPIYGIPDDFISVPLPAGLRGGKNLVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPHKLAEVLGQNPSYIFFRELAGSGNEGPVGALGTPLMGEYAGAIDRHYITLGAPLFVATAHPVTRKALNRLIMAQDTGSAIKGAVRVDYFWGYGDEAGELAGKQKTTGYVWQLLPNGMKPEYRP

SEQ ID NO: 2197 - protein, 441 aa, Neisseria; identical to SEQ ID NO: 2172

SEQ ID NO: 2198 - protein, 6 aa, Artificial Sequence
  Synthetic Construct
CGGGGS

SEQ ID NO: 2199 - protein, 5 aa, Artificial Sequence
  Synthetic Construct
CGGGS

SEQ ID NO: 2200 - protein, 4 aa, Artificial Sequence
  Synthetic Construct
CGGS

SEQ ID NO: 2201 - protein, 6 aa, Artificial Sequence
  Synthetic Construct
  VARIANT (1)...(6): Xaa = Any Amino Acid
CGXGGS

SEQ ID NO: 2202 - protein, 6 aa, Artificial Sequence
  Synthetic Construct
  VARIANT (1)...(6): Xaa = Any Amino Acid
CGXXGS

SEQ ID NO: 2203 - protein, 6 aa, Artificial Sequence
  Synthetic Construct
  VARIANT (1)...(6): Xaa = Any Amino Acid
CGXGXS

SEQ ID NO: 2204 - protein, 7 aa, Artificial Sequence
  Synthetic Construct
  VARIANT (1)...(7): Xaa = Any Amino Acid
CGGXGGS

SEQ ID NO: 2205 - protein, 7 aa, Artificial Sequence
  Synthetic Construct
  VARIANT (1)...(7): Xaa = Any Amino Acid
CGXGGGS

SEQ ID NO: 2206 - protein, 202 aa, Neisseria meningitidis; identical to SEQ ID NO: 1964

SEQ ID NO: 2207 - protein, 274 aa, Neisseria meningitidis; identical to SEQ ID NO: 1790

The invention claimed is:

1. The hybrid protein comprising formula:

$NH_2$-A-[-X-L-]$_n$-B—COOH wherein L is an optional linker amino acid sequence, A is an optional N-terminal amino acid sequence, B is an optional C-terminal amino acid sequence, and n is an integer greater than 1 and an $X_1$ portion of the $NH_2$-A-[-X-L-]$_n$-B—COOH formula comprises an amino acid sequence having at least 90% identity to SEQ ID NO: 2206 and an $X_2$ portion of the $NH_2$-A-[-X-L-]$_n$-B—COOH formula comprises an amino acid sequence having at least 90% identity to SEQ ID NO: 2207.

2. The hybrid protein of claim 1 wherein n=2.

3. The hybrid protein of claim 1, wherein L has 20 or fewer amino acids.

4. The hybrid protein of claim 1, wherein L is a poly-glycine linker.

5. The hybrid protein of claim 4, wherein the poly-glycine linker is GSGGGG (SEQ ID NO: 27).

6. The hybrid protein of claim 1, wherein A has 40 or fewer amino acids.

7. The hybrid protein of claim 1, wherein B has 40 or fewer amino acids.

8. A composition comprising the hybrid protein of claim 1 and a pharmaceutically acceptable carrier.

9. A method of inducing an immune response in a subject, comprising administering to the subject an effective amount of the composition of claim 8.

* * * * *